(12) United States Patent
Christensen et al.

(10) Patent No.: US 10,689,661 B2
(45) Date of Patent: Jun. 23, 2020

(54) NUCLEOTIDE SEQUENCES AND POLYPEPTIDES ENCODED THEREBY USEFUL FOR MODIFYING PLANT CHARACTERISTICS IN RESPONSE TO COLD

(71) Applicant: CERES, INC., Thousand Oaks, CA (US)

(72) Inventors: Cory Christensen, Sherwood, OR (US); Bonnie Hund, Denver, CO (US)

(73) Assignee: CERES, INC., Thousand Oaks, CA (US)

( * ) Notice: Subject to any disclaimer, the term of this patent is extended or adjusted under 35 U.S.C. 154(b) by 311 days.

(21) Appl. No.: 14/273,492

(22) Filed: May 8, 2014

(65) Prior Publication Data

US 2014/0245474 A1 Aug. 28, 2014

Related U.S. Application Data

(63) Continuation of application No. 12/863,773, filed as application No. PCT/US2009/031609 on Jan. 21, 2009, now abandoned.

(60) Provisional application No. 61/022,786, filed on Jan. 22, 2008.

(51) Int. Cl.
*C12N 15/82* (2006.01)
*C07K 14/415* (2006.01)

(52) U.S. Cl.
CPC ........ *C12N 15/8273* (2013.01); *C07K 14/415* (2013.01)

(58) Field of Classification Search
None
See application file for complete search history.

(56) References Cited

U.S. PATENT DOCUMENTS

| | | | |
|---|---|---|---|
| 2006/0057724 A1* | 3/2006 | Alexandrov | C07K 14/415 435/419 |
| 2007/0214517 A1 | 9/2007 | Alexandrov et al. | |
| 2013/0042367 A1 | 2/2013 | Nadzan et al. | |

FOREIGN PATENT DOCUMENTS

WO    WO 2007/044988 A2    4/2007

OTHER PUBLICATIONS

Churchman et al. Siamese, a plant-specific cell cycle regulator, controls endoreplication onset in *Arabidopsis thaliana*. The Plant Cell. 2006. 18:3145-3157.*
Peres et al. Novel plant-specific cyclin-dependent kinase inhibitors induced by biotic and abiotic stresses. Journal of Biological Chemistry. 2007. 282(35):25588-25596.*
GenBank Accession No. Q9LZ60. Siamese-related 3. published Feb. 17, 2016. pp. 1-3.*
GenBank Accession No. BX833341. published Feb. 6, 2004. pp. 1-2.*
Friedberg. Automated protein function prediction—the genomic challenge. Briefings in Bioinformatics. 2006. 7(3): 225-242.*
Dissmeyer et al. T-loop phosphorylation of *Arabidopsis* CDKA;1 is required for its function and can be partially substituted by an aspartate residue. The Plant Cell. 2007. 19:972-985.*
Low et al. Conformational switch upon phosphorylation: human CDK inhibitor p19IK4d between the native and partially folded state. ACS Chemical Biology. 2008. 4(1):53-63.*
Churchman, et al., Siamese, a plant-specific cell cycle regulator, controls endoreplication onset in *Arabidopsis thaliana*, The Plant Cell, 2006, 18(11): 3145-3157.
Dissmeyer, et al., T-Loop phosporylation of *Arabidopsis* CDKA;1 is required for its function and can be partially substituted by an aspartate residue, The Plant Cell, 2007, 19:972-985.
Gong, et al., "RNA helicase-like protein as an early regulator of transcription factor for plant chilling and freezing tolerance", PNAS, vol. 99, No. 17, Aug. 20, 2002, pp. 11507-11512.
Low, et al., Conformational switch upon phosphorylation: human CDK inhibitor p19INK4d between the native and partially folded state, ACS Chemical Biology, 2008, 4(1): 53-63.
NCBI GenBank Acession AAM6430, 5, Jan. 27, 2006.
Salaita, et al., "Identification and characterization of mutants capable of seed germination at 10° C. from activation-tagged lines of *Arabidopsis thaliana*", Journal of Experimental Botany, vol. 56, No. 418, Aug. 2005, pp. 2059-2069.
Yi, et al., "The pepper transcription factor CaPF1 confers pathogen and freezing tolerance in *Arabidopsis*", Plant Physiology, vol. 136, No. 1, Sep. 3, 2004, pp. 2862-2874.
Zhou, et al., Plant CDK inhibitors: studies of interaction with cell cycle regulators in the yest two-hybrid system and functional comparisons in transgenic *Arabidopsis* plants. Plant Cell Rep. 2002. 20: 967-975.
Dissmeyer et al , "T-Loop Phosphorylation of *Arabidopsis* CDKA;1 is required for its function and can be partially substituted by an aspartate residue," . *The Plant Cell* vol. 19:972-985; Mar. 2007.
Friedberg, " Automated protein function prediction—the genomic challenge," *Briefings in Bioinformatics;* vol. 7. No. 3. 225-242; Jan. 2006.
Guerois et al., "Predicting changes in the stability of proteins and protein complexes: A study of more than 1000 mutations", *J. Mol. Biol.*; 320; 369-287; 2002.

(Continued)

*Primary Examiner* — Ashley K Buran

(74) *Attorney, Agent, or Firm* — Dentons US LLP

(57) ABSTRACT

Methods and materials for modulating cold tolerance levels in plants are disclosed. For example, nucleic acids encoding cold tolerance-modulating polypeptides are disclosed as well as methods for using such nucleic acids to transform plant cells. Also disclosed are plants having increased cold tolerance levels and plant products produced from plants having increased cold tolerance levels.

10 Claims, 18 Drawing Sheets

Specification includes a Sequence Listing.

(56) References Cited

OTHER PUBLICATIONS

Kumar et al., "Predicting the effects of coding non-synonymous variants on protein function using the SIFT algorithm," www.nature.com/natureprotocols; *Nature Protocols;* vol. 4 No. 8; 2009.
Ng et al., Predicting the effects of amino acid substitutions on protein function, *Annual Review Genom. Hum. Genet*; 7:61-80; 2006
Reva et al., Predicting the functional impact of protein mutations: application to cancer genomics,: *Nucleic Acids Research*; vol. 39. No. 17.; e118; Jul. 2011.
Rivera et al., Genomic evidence for two functionally distinct gene classes, *Proc. Natl. Acad. Sci.*; vol. 95; 6239-6244; May 1998.
Sandhya et al., "CUSP: an algorithm to distinguish structurally conserved and unconserved regions in protein domain alignments and its application in the study of large length variations," *BMC Structural Biol*; 8:28; May 2008.

\* cited by examiner

FIGURE 1

| | | | | | | |
|---|---|---|---|---|---|---|
| SEQ-ID-NO-15 | -MN\|DL\|I |----------| ---------- | ---------- | QD\|LPM\|LKF\|PS\|-P | 17 |
| SEQ-ID-NO-17 | MDDLELL | ---------- | ---------- | ---------- | QD\|LSQ\|FNF\|PA\|-T | 18 |
| SEQ-ID-NO-2 | MAEICCV | ---------- | ---------- | ---------- | VEK\|I\|RL\|PTRP | 24 |
| SEQ-ID-NO-8 | -MEF\|DI\|LKRP | ----LPVKCQT | TTSS- | ---KEI\|QEED | EGEI NVKAAG | 40 |
| SEQ-ID-NO-10 | -MEF\|NF\|L\|VRS | ALELGDDCEI | VPQDLHQEKE | SFSPGKQQKE | ECEI SVPT\|LK | 49 |

| | | | | | | |
|---|---|---|---|---|---|---|
| SEQ-ID-NO-15 | ---KI PS\|---N | N\|T NRD\|D\|D\|GSS | GG\|--\|CI\|TPTS | SDHKI PP\|S\|TA | TT PPP\|P\|PQKR | 61 |
| SEQ-ID-NO-17 | ---KI PS\|KTSK | DNKD\|G\|DGND | EGF\|SC\|S\|TPTS | QEHKI P-\|SV\|H | DS\|P\|PP\|P\|PRKP | 66 |
| SEQ-ID-NO-2 | EL\|DI\|PV\|---S | DHED\|PT\|VNEE | EG\|--\|CKTPTS | SDHKI PEVKY | TL\|CPPAPRKP | 69 |
| SEQ-ID-NO-8 | EGKEEKKEK | NSKEI\|D\|D\|D\|D | DG\|--\|FKTPTS | TDSKI P-\|AEP | KQ\|CPPAPRKP | 86 |
| SEQ-ID-NO-10 | -I KLPS\|VEAF | QT EDD\|K\|D\|D\|D\|D | DG\|--\|FKTPTS | LDRKI P-\|VI F\| | -QCPPAPRKP | 94 |

| | | | | | | |
|---|---|---|---|---|---|---|
| SEQ-ID-NO-15 | RP\|----P -PS | PS\|CFI\|RSCKR | KLL\|TPSKVEI | I VNKDEI ERF | FSSVYNHSTT | 106 |
| SEQ-ID-NO-17 | R\|ALPSKPSPI\|- | AAL\|VI\|RSCKR | KLL\|V\|S\|AP-EI | I MNKEEI DRF | FSSVY\|S\|DTST | 115 |
| SEQ-ID-NO-2 | KP\|NRSSG-\|TK | RKLTPVNVLN | RI P\|I\|DLS-- | ---REI EMF\| | F\|E------- | 103 |
| SEQ-ID-NO-8 | KP\|NKRKA-\|SS\| | PTNGSTAV\|RN | PL\|LLDLS-- | ---EELESL | SH------- | 120 |
| SEQ-ID-NO-10 | K\|-------\|SL\| | PSAKRKSP\|QR | RVLLDLS-- | ---NEI ESL | F\|PPAL\|A\|GDLG | 130 |

| | | | |
|---|---|---|---|
| SEQ-ID-NO-15 | SSPTTTTKK ALAVVR\|RRR\|S | F\|R\|SCSRR | 133 |
| SEQ-ID-NO-17 | TA------- ------\|KRRR\| | YLYCARR | 129 |
| SEQ-ID-NO-2 | --------- ------\|DL\|DRR\| | I \|KKSRKQ | 115 |
| SEQ-ID-NO-8 | --------- ------\|KVKKK\| | TRI\|QEQQ | 132 |
| SEQ-ID-NO-10 | G-------- ------\|KI KKV\| | R\|QGNDT\|K\| | 143 |

FIGURE 2

Sequence alignment figure showing SEQ ID NOs 20, 32, 28, 22, 40, 44, 58, and 71 across four alignment blocks with position numbers ending at 41/41/41/41/35/41/43/43, 84/88/91/90/79/85/87/87, 134/137/138/136/118/123/127/136, and 175/174/180/169/154/162/162/174 respectively.

Figure 3:
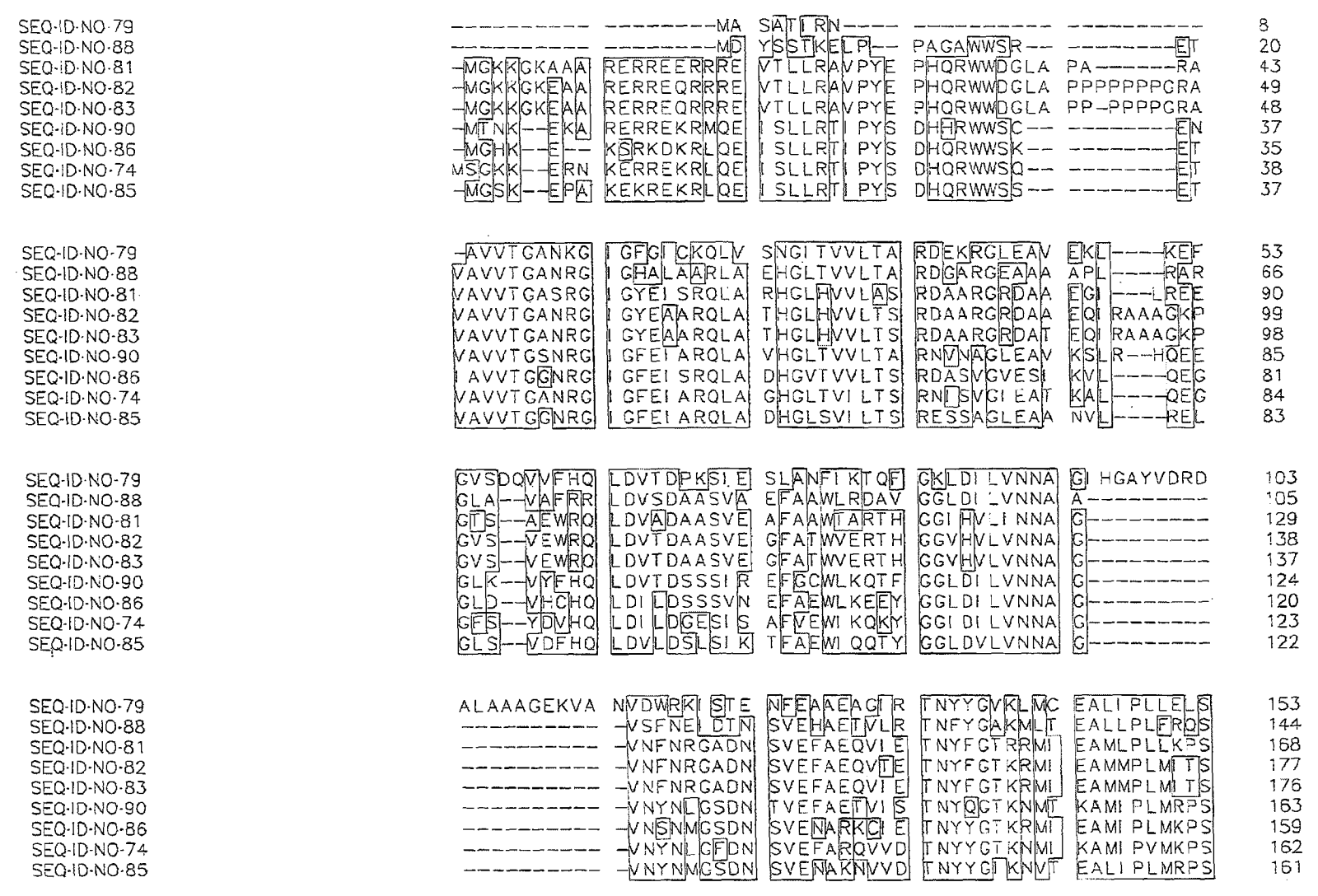

[Sequence alignment figure showing multiple sequence alignments of SEQ ID NOs: 79, 88, 81, 82, 83, 90, 86, 74, and 85, displayed in four blocks with residue position numbers on the right side of each block.]

FIGURE 3 (Continued)

[Sequence alignment figure showing multiple protein sequences labeled SEQ-ID-NO-79, SEQ-ID-NO-88, SEQ-ID-NO-81, SEQ-ID-NO-82, SEQ-ID-NO-83, SEQ-ID-NO-90, SEQ-ID-NO-86, SEQ-ID-NO-74, and SEQ-ID-NO-85, with residue position numbers on the right]

FIGURE 4

| | | | | | | |
|---|---|---|---|---|---|---|
| SEQ-ID-NO-104 | ---MCEALIPLL | ELSL-GTPRIV | NVSSSMGKL- | ----EKIPNAW | ARGA SDAES | 44 |
| SEQ-ID-NO-95  | MLTEALLPLF  | RQSPATSRIL | NISSQLGLL  | ---NKVSDPS | LKALLDEET | 46 |
| SEQ-ID-NO-98  | ---MIKAMIPVM | KPSITAGARIV | NVSSR-GRLN | GRRNRIQDAT | LREKLTNLET | 49 |
| SEQ-ID-NO-107 | ---MIEAMMPLM | ITSPHGGRIV | NVSSRLGRVN | GRRNRIGDPS | LRERLLNDDH | 49 |
| SEQ-ID-NO-93  | ---MIEAMLPLL | KPSPYGGRIV | NVSSRLGRAN | GRRNKIGDAI | LREQLLTDDC | 49 |
| SEQ-ID-NO-106 | ---MIEAMLPLL | KPSPYGGRIV | NVSSRLGRAN | GRRNKIGDAI | LREQLLTDDC | 49 |

| | | | | | | |
|---|---|---|---|---|---|---|
| SEQ-ID-NO-104 | LTEEKVDEVL | NQFLKDFKEG | SL-ETKGWPH | AFSAYLVSKA | ALTAYTRILA | 93 |
| SEQ-ID-NO-95  | LTEAAIDAMV | SRFLAQVKDG | TW-GAQGWPK | VWTDYSVSKL | ALNAYSRLLA | 95 |
| SEQ-ID-NO-98  | LSEELIDRTV | SSFLQQVEDE | TW-QSGGWPQ | TFTDYSVSKL | AVNAYTRLVA | 98 |
| SEQ-ID-NO-107 | LSEELINEMV | MKFLEQITKQD | NWS-SSNEWPQ | MYTDYSISKL | AVNAYTRLLA | 99 |
| SEQ-ID-NO-93  | LSEELIGGIV | TKFLEQVKQN | SW-SSIEWPQ | MYTDYSISKL | AVNMYTRLMA | 98 |
| SEQ-ID-NO-106 | LSEELIDGMV | TKFLEQVKQN | SW-SSIEWPQ | MYTDYSVSKF | AVNMYTRLMA | 98 |

| | | | | | | |
|---|---|---|---|---|---|---|
| SEQ-ID-NO-104 | KKYPS----- | -FCINAVCPG | FVKTDLN-YN | TGYLSVDEGA | ESVVRLALLP | 136 |
| SEQ-ID-NO-95  | RRLQAR--GA | RVSVNCFCPG | FTRTDMTRGW | -CKRTAEEAA | DVGARLALLP | 142 |
| SEQ-ID-NO-98  | KELCDRPQGE | KIYINCYCPG | MVKTAMT-GW | AGNISPEVAA | DTGVWLSLLS | 147 |
| SEQ-ID-NO-107 | RRLLDRPEGQ | KIYINCFCPG | MVKTAMT-GW | EGNISAEEGA | DTGVWLALVP | 148 |
| SEQ-ID-NO-93  | KRLADRSEGQ | KIYINCFCPG | MVKTAMT-DW | EGNISAEEGA | DTGVWLALLP | 147 |
| SEQ-ID-NO-106 | RRLSDRSEGQ | KIYINCFCPG | MVKTAMT-DW | EGNISAEEGA | DTGVWLALLP | 147 |

| | | | |
|---|---|---|---|
| SEQ-ID-NO-104 | NG-GPSGLFF | SRSEVAPF--- | 153 |
| SEQ-ID-NO-95  | PGELPTGAFF | KWCTPQPYSK L | 163 |
| SEQ-ID-NO-98  | DQLALTGKFF | AERREINF--- | 164 |
| SEQ-ID-NO-107 | QEQATIGKFF | AERREISF--- | 166 |
| SEQ-ID-NO-93  | QAQATIGKFY | AERREISF--- | 165 |
| SEQ-ID-NO-106 | QEQATIGKFY | AERREISF--- | 165 |

| SEQ ID | Sequence | Pos |
|---|---|---|
| SEQ:ID:NO:143 | AEECLPQLDM TQNPPMQELV AKDLHGNEWH FRHI FRGQPR RHLL TGWSV | 192 |
| SEQ:ID:NO:123 | ADECLPPLDM TQSPPTQELV AKDLHSMDWR FRHI FRGQPR RHLL QSGWSV | 200 |
| SEQ:ID:NO:121 | ADECLPPLDM SRQPPTQELV AKDLHGVEWR FRHI FRGQPR RHLL QSGWSV | 219 |
| SEQ:ID:NO:120 | ADECLPPLDM SRQPPTQELV AKDLHGVEWR FRHI FRGQPR RHLL QSGWSV | 220 |
| SEQ:ID:NO:124 | ADECLPPLDM SRQPPTQELV AKDLHGVEWR FRHI FRGQPR RHLL QSGWSV | 203 |
| SEQ:ID:NO:125 | ADECLPPLDM SRQPPTQELV AKDLHGVEWR FRHI FRGQPR RHLL QSGWSV | 219 |
| SEQ:ID:NO:126 | ADECLPPLDM SRQPPTQELV AKDLHGNEWR FRHI FRGQPR RHLL QSGWSV | 220 |
| SEQ:ID:NO:114 | ADECLPPLDM SRQPPTQELV AKDLHGNEWR FRHI FRGQPR RHLL QSGWSV | 229 |
| SEQ:ID:NO:116 | ADECLPPLDM SRQPPTQELV AKDLHASEWR FRHI FRGQPR RHLL QSGWSV | 229 |
| SEQ:ID:NO:119 | ADECLPPLDM SRQPPTQELV AKDLHANEWR FRHI FRGQPR RHLL QSGWSV | 230 |
| SEQ:ID:NO:118 | ADECLPPLDM SRQPPTQELV AKDLHANEWR FRHI FRGQPR RHLL QSGWSV | 235 |
| SEQ:ID:NO:112 | ADECLPPLDM SRQPPTQELV AKDLHGAKWR FRHI FRGQPR RHLL TGWSS | 235 |
| SEQ:ID:NO:117 | ADECLPPLDM SRQPPTQELV AKDLHGMKWR FRHI YRGQPR RHLL TGWSS | 235 |
| SEQ:ID:NO:134 | AEDCFPPLDY QQIRPSQELV ARDLHGLEWR FRHI YRGQPR RHLL TGWSA | 198 |
| SEQ:ID:NO:136 | AEDCFPPLDY EQLRPSQELL AKDLHGMKWR FRHI YRGQPR RHLL TGWSA | 201 |
| SEQ:ID:NO:131 | AEDCFPPLDY SQPRPSQELL ARDLHGLEWR FRHI YRGQPR RHLL TGWSA | 230 |
| SEQ:ID:NO:132 | AEDCFPPLDY SQPRPSQELL ARDLHGLEWR FRHI YRGQPR RHLL TGWSA | 230 |
| SEQ:ID:NO:128 | AEDCFPPLDY SQPRPSQELV AKDLHSTEWR FRHI YRGQPR RHLL TGWSA | 230 |
| SEQ:ID:NO:127 | AEDCFPPLDY SQQRPSQELV AKDLHGTEWR FRHI YRGQPR RHLL TGWSA | 213 |
| SEQ:ID:NO:138 | AEDCFPPLDY SQQRPSQELV AKDLHGTEWR FRHI YRGQPR RHLL TGWSA | 213 |

| SEQ ID | Sequence | Pos |
|---|---|---|
| SEQ:ID:NO:143 | FVSSKRLVAG DAFI FLRGEN GELRVGVRRL MRQL NNMPSS VI SSHSMHLG | 242 |
| SEQ:ID:NO:123 | FVSSKRLVAG DAFI FLRGEN GELRVGVRRA MRQL SNVPSS VI SSQSMHLG | 250 |
| SEQ:ID:NO:121 | FVSAKRLVAG DAFI FLRGEN GELRVGVRRA MRQQ TNVPSS VI SSHSMHLG | 269 |
| SEQ:ID:NO:120 | FVSAKRLVAG DAFI FLRGEN GELRVGVRRA MRQQ TNVPSS VI SSHSMHLG | 270 |
| SEQ:ID:NO:124 | FVSAKRLVAG DAFI FLRGEN GELRVGVRRA MRQQ TNVPSS VI SSHSMHLG | 253 |
| SEQ:ID:NO:125 | FVSSKRLVAG DAFI FLRGEN GELRVGVRRA MRQQ TNVPSS VI SSHSMHLG | 269 |
| SEQ:ID:NO:126 | FVSSKRLVAG DAFI FLRGEN GELRVGVRRA MRQQ GNVPSS VI SSHSMHLG | 270 |
| SEQ:ID:NO:114 | FVSSKRLVAG DAFI FLRGEN GELRVGVRRA MRQQ GNVPSS VI SSHSMHLG | 279 |
| SEQ:ID:NO:116 | FVSSKRLVAG DAFI FLRGEN GELRVGVRRA MRQQ GNVPSS VI SSHSMHLG | 279 |
| SEQ:ID:NO:119 | FVSSKRLVAG DAFI FLRGEN GELRVGVRRA MRQQ GNVPSS VI SSHSMHLG | 280 |
| SEQ:ID:NO:118 | FVSSKRLVAG DAFI FLRGEN GELRVGVRRA MRQQ GNVPSS VI SSHSMHLG | 285 |
| SEQ:ID:NO:112 | FVSSKRLVSG DAFI FLRGEN GELRVGVRRA MRQQ GNVPSS VI SSHSMHLG | 285 |
| SEQ:ID:NO:117 | FVNKKKLVSG DAFI FLRGDD GELRLGVRRA QL KNEALLK AFNSNS SKI | 285 |
| SEQ:ID:NO:134 | FI NKKKLVSG DAVL FLRGND GELRLGVRRA VQL KNEALLE AVNCTD SKL | 248 |
| SEQ:ID:NO:136 | FVNKKKLVSG DAVL FLRGDD GKLRLGVRRA SQI EGTAALS AQYNQ MNHN | 251 |
| SEQ:ID:NO:131 | FVNKKKLVSG DAVL FLRGDD GKLRLGVRRA SQI EGTAALS AQYNQ MNHN | 280 |
| SEQ:ID:NO:132 | FVNKKKLVSG DAVL FLRGDD GELRLGVRRA SQI EGTAALS AQYNQ MNHN | 280 |
| SEQ:ID:NO:128 | FVNKKKLVSG DAVL FLRGDD GELRLGVRRA AQL KNGSAFF ALYNQCSNLG | 280 |
| SEQ:ID:NO:127 | FVNKKKLVSG DAVL FLRGDD GELRLGVRRA AQL KNGSAFF ALYNQCSNLG | 263 |
| SEQ:ID:NO:138 | FVNKKKLVSG DAVL FLRGDD GELRLGVRRA AQL KNGSAFP ALYNQCSNLG | 263 |

FIGURE 5 (Continued)

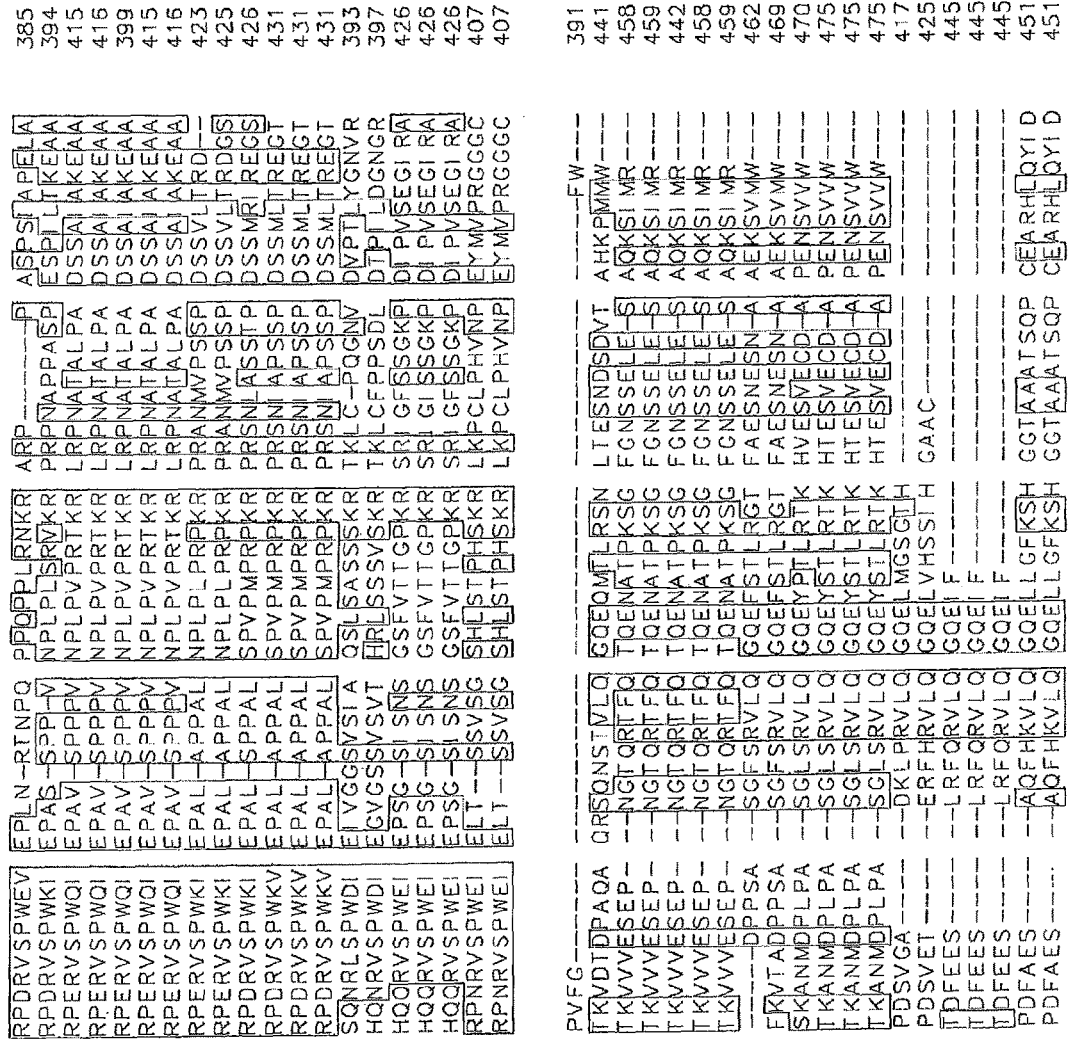
FIGURE 5 (Continue)

| | | | |
|---|---|---|---|
| SEQ-ID-NO-143 | ESDVPQSDSD | NSAPVSADKD | 676 |
| SEQ-ID-NO-123 | ---------- | ---------- | 808 |
| SEQ-ID-NO-121 | CLSTSSLNSE | NC-------- | 857 |
| SEQ-ID-NO-120 | CLSTSSLNSE | NC-------- | 853 |
| SEQ-ID-NO-124 | CLSTSSLNSE | NC-------- | 836 |
| SEQ-ID-NO-125 | CLSTSSLNSE | NC-------- | 852 |
| SEQ-ID-NO-126 | CLSTSSLNSE | NC-------- | 853 |
| SEQ-ID-NO-114 | LPLPSACSPM | NC-------- | 845 |
| SEQ-ID-NO-116 | LPLPSACSPM | NC-------- | 852 |
| SEQ-ID-NO-119 | ASNPSLSSAG | NS-------- | 848 |
| SEQ-ID-NO-118 | ASNPSLSSAG | NS-------- | 859 |
| SEQ-ID-NO-112 | ASNPSLSSAG | NS-------- | 859 |
| SEQ-ID-NO-117 | ASNPSLSSAG | NS-------- | 859 |
| SEQ-ID-NO-134 | LCAAPLGI-- | ---------- | 660 |
| SEQ-ID-NO-136 | LCAAPLGI-- | ---------- | 680 |
| SEQ-ID-NO-131 | MRDMLLDIAL | ---------- | 608 |
| SEQ-ID-NO-132 | MRDMLLDIAL | ---------- | 608 |
| SEQ-ID-NO-128 | MRDMLLDIAL | ---------- | 608 |
| SEQ-ID-NO-127 | LDVGVGALIM | ---------- | 719 |
| SEQ-ID-NO-138 | LDVGVGALIM | ---------- | 719 |

FIGURE 5 (Continued)

| | | | | | |
|---|---|---|---|---|---|
| SEQ-ID-NO-15 | -MNLDLI- | ---- | ---- | ---- | ---- | 17 |
| SEQ-ID-NO-17 | MDDLELL- | ---- | ---- | QD- | LPMLKFPS-P | 18 |
| SEQ-ID-NO-2  | MAEICCV- | ---- | ---- | QD- | LSQFNFPA-T | 24 |
| SEQ-ID-NO-8  | MEFDILKRP | ---LPVKCQT | TTSS---- | -KEIQEED | VEKIRLPTRP | 40 |
| SEQ-ID-NO-10 | MEFNFLVRS | ALELGDDCEI | VPQDLHQEKE | SFSPGKQQKE<br>VLEKEEKQED | EGEINVKAAG<br>ECEISVPTLK | 49 |

| | | | | | |
|---|---|---|---|---|---|
| SEQ-ID-NO-15 | -KIPS---N | NTNRDDDGSS | GG--CTPTS | SDHKIPPSTA | TTPPPPPQKR | 61 |
| SEQ-ID-NO-17 | -KIPSKTSK | DNKDGDND | EGFSCSTPTS | QEHKIP-SVH | DSPPPPPRKP | 66 |
| SEQ-ID-NO-2  | ELDIPV--S | DHEDPTVNEE | EG--CKTPTS | SDHKIPEVKY | TLCPPAPRKP | 69 |
| SEQ-ID-NO-8  | EGKEEKKEK | NSKEDDDD | DG--FKTPTS | TDSKIP-AEP | KQCPPAPRKP | 86 |
| SEQ-ID-NO-10 | KLPSVEAF | QIEDDKDDDD | DG--FKTPTS | LDRKIP-VIF | -QCPPAPRKP | 94 |

| | | | | | |
|---|---|---|---|---|---|
| SEQ-ID-NO-15 | RP-----P-PS | PSCFIRSCKR | KLLTPSKVEI | IVNKDEIERF | FSSVYNHSTT | 106 |
| SEQ-ID-NO-17 | RALPSKPSPT | AALVIRSCKR | KLLVSAP-EI | IMNKEEIDRF | FSSVYSDTST | 115 |
| SEQ-ID-NO-2  | KPNRSSG--TK | RKLTPVNVLN | RIPIDLS-- | -REIEMF-- | FE------ | 103 |
| SEQ-ID-NO-8  | KPNKRKA-SS | PTNGSTAVRN | PLLLDLS-- | -EELESL-- | SH------ | 120 |
| SEQ-ID-NO-10 | K------SL | PSAKRKSPQR | RVLLDLS-- | -NEIESL-- | EPPALAGDLG | 130 |

| | | |
|---|---|---|
| SEQ-ID-NO-15 | SSPTTTTKK | ALAVVRRRRS | FRSCSRR | 133 |
| SEQ-ID-NO-17 | TA------ | ----KRRRR | YLYCARR | 129 |
| SEQ-ID-NO-2  | ------ | ----DLDRR | IKKSRKQ | 115 |
| SEQ-ID-NO-8  | ------ | ----KVKKK | TRITQEQQ | 132 |
| SEQ-ID-NO-10 | G------ | ----KIKKV | RQGNDTK | 143 |

NUCLEOTIDE SEQUENCES AND POLYPEPTIDES ENCODED THEREBY USEFUL FOR MODIFYING PLANT CHARACTERISTICS IN RESPONSE TO COLD

CROSS REFERENCE TO RELATED APPLICATIONS

This application is a Continuation of application Ser. No. 12/863,773, filed on Nov. 23, 2010. Application Ser. No. 12/863,773 is the U.S. National Phase Application of International No. PCT/US2009/031609, filed on Jan. 21, 2009, which claims priority under 35 U.S.C. 119(e) to U.S. Provisional Application No. 61/022,786, filed on Jan. 22, 2008. The entire contents of all applications listed above are hereby incorporated by reference.

INCORPORATION-BY-REFERENCE OF SEQUENCE LISTING OR TABLE

The material in the accompanying sequence listing is hereby incorporated by reference into this application. The accompanying file, named 2007-11-27_2750-1707PUS1_Sequence Listing.txt was created on Nov. 27, 2007 and is 459 KB. The file can be accessed using Microsoft Word on a computer that uses Windows OS.

TECHNICAL FIELD

This document relates to methods and materials involved in modulating cold tolerance in plants, including growth levels in plants grown under low or chilling temperature stress conditions (a.k.a. "cold stress"). For example, this document provides plants having increased growth rate, vegetative growth, seedling vigor and/or biomass under cold stress conditions as compared to wild-type plants grown under similar conditions, as well as materials and methods for making plants and plant products having increased growth levels under cold stress conditions.

BACKGROUND

Plants are constantly exposed to a variety of biotic (i.e. pathogen infection and insect herbivory) and abiotic (i.e. high or low temperature, drought, flood and salinity) stresses. To survive these challenges to their sessile life, plants have developed elaborate mechanisms to perceive external signals and to manifest adaptive responses with proper physiological and morphological changes (Bohnert et al. 1995). Plants exposed to cold or chilling conditions typically have low yields of biomass, seeds, fruit and other edible products. The term "chilling sensitivity" is used for the description of physiological and developmental damages in the plant caused by low, but above freezing, temperatures. Important agricultural crop plants such as corn, soybean, rice and cotton have tropical ancestors that make them chilling sensitive. In some countries or agricultural regions of the world chilling temperatures are a significant cause of crop losses and a primary factor limiting the geographical range and growing season of many crop species. Another example is that chilling conditions can cause significant concern in early spring planting of corn or canola. Poor germination and reduced growth of chilling sensitive crops in the spring results in less ground coverage, more erosion and increased occurrence of weeds leading to less nutrient supply for the crop.

Typically, chilling damage includes wilting, necrosis or ion leakage from cell membranes, especially calcium leakage, and decreased membrane fluidity, which consequently impacts membrane dependent processes such as: photosynthesis, protein synthesis, ATPase activity, uptake of nitrogen, etc. (see Levitt J (1980) Chilling injury and resistance. In Chilling, Freezing, and High Temperature Stresses: Responses of Plant to Environmental Stresses, Vol 1., T T Kozlowsky, ed, Academic Press, New York, pp 23-64; Graham and Patterson (1982) *Annu Rev Plant Physiol* 33: 347-372; Guy (1990) *Annu Rev Plant Physiol Plant Mol Biol* 41: 187-223; and Nishida and Murata (1996) *Annu Rev Plant Physiol Plant Mol Biol* 47: 541-568.). In addition, cold temperatures are often associated with wet conditions. The combination of cold and wet can result in hypoxic stress on the roots, causing an even more severe reduction of growth rate but, more critically, can be lethal to the plants, especially sensitive plant species such as corn and cotton.

Yet it has been observed that environmental factors, such as low temperature, can serve as triggers to induce cold acclimation processes allowing plants responding thereto to survive and thrive in low temperature environments. It would, therefore, be of great interest and importance to be able to identify genes that regulate or confer improved cold acclimation characteristics to enable one to create transformed plants (such as crop plants) with improved cold tolerance characteristics such as faster germination and/or growth and/or improved nitrogen uptake under cold conditions to improve survival or performance under low or chilling temperatures.

In the fields of agriculture and forestry, efforts are constantly being made to produce plants with an increased growth potential in order to feed the ever-increasing world population and to guarantee the supply of reproducible raw materials. This is done conventionally through plant breeding. The breeding process is, however, both time-consuming and labor-intensive. Furthermore, appropriate breeding programs must be performed for each relevant plant species.

Progress has been made in part by the genetic manipulation of plants; that is by introducing and expressing recombinant nucleic acid molecules in plants. Such approaches have the advantage of not usually being limited to one plant species, but instead being transferable among plant species. There is a need for generally applicable processes that improve forest or agricultural plant growth potential. Therefore, the present invention relates to a method for increasing growth potential, decreasing chilling damage, and/or increasing levels of cold acclimation in plants under low temperature, chilling or cold conditions, characterized by expression of recombinant DNA molecules stably integrated into the plant genome.

SUMMARY

This document provides methods and materials related to plants having modulated levels of cold tolerance. For example, this document provides transgenic plants and plant cells having increased levels of cold tolerance, nucleic acids (i.e. isolated polynucleotides), polypeptides encoded thereby used to generate transgenic plants and plant cells having increased levels of cold tolerance, and methods for making plants and plant cells having increased levels of cold tolerance. Such plants and plant cells having increased biomass levels may be useful in producing biomass for conversion to a liquid fuel or other chemicals, or may be useful as a thermochemical fuel.

Methods of producing a plant and/or plant tissue are provided herein. In one aspect, a method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 130, 180, 650, or 315, using an HMM generated from the amino acid sequences depicted in one of FIG. 1, 2, 3, or 4, respectively. The plant and/or plant tissue has a difference in the level of cold tolerance as compared to the corresponding level of cold tolerance of a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence encoding a polypeptide having 80 percent or greater sequence identity to an amino acid sequence set forth in SEQ ID NOs: 2, 20, 74, or 93. A plant and/or plant tissue produced from the plant cell has a difference in the level of cold tolerance as compared to the corresponding level of cold tolerance of a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence having 80 percent or greater sequence identity to a nucleotide sequence or at a fragment thereof set forth in SEQ ID NO:1, 19, 92, 97, or 111. A plant and/or plant tissue produced from the plant cell has a difference in the level of cold tolerance as compared to the corresponding level of cold tolerance of a control plant that does not comprise the exogenous nucleic acid.

Methods of modulating the level of cold tolerance in a plant are provided herein. In one aspect, a method comprises introducing into a plant cell an exogenous nucleic acid, that comprises a regulatory region operably linked to a nucleotide sequence encoding a polypeptide. The HMM bit score of the amino acid sequence of the polypeptide is greater than about 130, 180, 650, 315 or 790 using an HMM generated from the amino acid sequences depicted in any one of FIG. 1, 2, 3, 4 or 5, respectively. A plant and/or plant tissue produced from the plant cell has a difference in the level of cold tolerance as compared to the corresponding level of cold tolerance of a control plant that does not comprise the exogenous nucleic acid.

In certain embodiments, the amino acid sequence of the polypeptide has an HMM score greater than about 180, using an HMM generated from the amino acid sequences depicted in FIG. 2, wherein the polypeptide comprises an CCT motif domain having 80 percent or greater sequence identity to amino acid residues 285 to 329 of SEQ ID NO:20, residues 291 to 335 of SEQ ID NO:22, residues 235 to 279 of SEQ ID NO:24, residues 217 to 261 of SEQ ID NO:26, residues 311 to 355 of SEQ ID NO:28, residues 285 to 329 of SEQ ID NO:29, residues 281 to 325 of SEQ ID NO:30, residues 302 to 346 of SEQ ID NO:32, residues 289 to 333 of SEQ ID NO:34, residues 295 to 339 of SEQ ID NO:36, residues 261 to 305 of SEQ ID NO:38, residues 284 to 328 of SEQ ID NO:40, residues 288 to 332 of SEQ ID NO:42, residues 261 to 305 of SEQ ID NO:43, residues 239 to 283 of SEQ ID NO:44, residues 294 to 338 of SEQ ID NO:45, residues 279 to 323 of SEQ ID NO:46, residues 261 to 305 of SEQ ID NO:47, residues 239 to 283 of SEQ ID NO:48, residues 294 to 338 of SEQ ID NO:49, residues 261 to 305 of SEQ ID NO:50, residues 298 to 342 of SEQ ID NO:51, residues 241 to 285 of SEQ ID NO:52, residues 268 to 312 of SEQ ID NO:53, residues 245 to 289 of SEQ ID NO:54, residues 238 to 282 of SEQ ID NO:56, residues 245 to 289 of SEQ ID NO:58, residues 279 to 323 of SEQ ID NO:59, residues 236 to 280 of SEQ ID NO:60, residues 250 to 294 of SEQ ID NO:61, residues 322 to 366 of SEQ ID NO:62, residues 297 to 341 of SEQ ID NO:63, residues 348 to 392 of SEQ ID NO:64, residues 312 to 356 of SEQ ID NO:65, residues 340 to 384 of SEQ ID NO:68, residues 307 to 351 of SEQ ID NO:69, or residues 253 to 297 of SEQ ID NO:71.

In certain embodiments, the amino acid sequence of the polypeptide has an HMM score greater than about 180, using an HMM generated from the amino acid sequences depicted in FIG. 2, wherein the polypeptide comprises a B-box zinc finger domain having 80 percent or greater sequence identity to amino acid residues 56 to 103 of SEQ ID NO:20, residues 62 to 109 of SEQ ID NO:22, residues 64 to 106 of SEQ ID NO:24, residues 34 to 81 of SEQ ID NO:26, residues 63 to 110 of SEQ ID NO:28, residues 56 to 103 of SEQ ID NO:29, residues 56 to 103 of SEQ ID NO:30, residues 60 to 107 of SEQ ID NO:32, residues 56 to 103 of SEQ ID NO:34, residues 51 to 98 of SEQ ID NO:36, residues 70 to 112 of SEQ ID NO:38, residues 51 to 98 of SEQ ID NO:40, residues 52 to 99 of SEQ ID NO:42, residues 72 to 114 of SEQ ID NO:43, residues 62 to 104 of SEQ ID NO:44, residues 50 to 97 of SEQ ID NO:45, residues 55 to 102 of SEQ ID NO:46, residues 72 to 114 of SEQ ID NO:47, residues 62 to 104 of SEQ ID NO:48, residues 50 to 97 of SEQ ID NO:49, residues 27 to 71 of SEQ ID NO:50, residues 60 to 107 of SEQ ID NO:51, residues 1 to 48 of SEQ ID NO:52, residues 1 to 48 of SEQ ID NO:53, residues 1 to 48 of SEQ ID NO:54, residues 62 to 104 of SEQ ID NO:56, residues 64 to 106 of SEQ ID NO:58, residues 1 to 48 of SEQ ID NO:59, residues 61 to 103 of SEQ ID NO:60, residues 70 to 112 of SEQ ID NO:61, residues 52 to 99 of SEQ ID NO:62, residues 51 to 98 of SEQ ID NO:63, residues 77 to 119 of SEQ ID NO:64, residues 59 to 106 of SEQ ID NO:65, residues 59 to 106 of SEQ ID NO:68, residues 34 to 66 of SEQ ID NO:69, or residues 64 to 106 of SEQ ID NO:71.

In certain embodiments, the amino acid sequence of the polypeptide has an HMM score greater than about 650, using an HMM generated from the amino acid sequences depicted in FIG. 3, wherein the polypeptide comprises an short-chain dehydrogenase domain having 80 percent or greater sequence identity to amino acid residues 38 to 173 of SEQ ID NO:74, residues 37 to 174 of SEQ ID NO:76, residues 23 to 160 of SEQ ID NO:77, residues 7 to 168 of SEQ ID NO:79, residues 43 to 179 of SEQ ID NO:81, residues 49 to 188 of SEQ ID NO:82, residues 48 to 187 of SEQ ID NO:83, residues 37 to 172 of SEQ ID NO:85, residues 35 to 170 of SEQ ID NO:86, residues 20 to 160 of SEQ ID NO:88, or residues 37 to 174 of SEQ ID NO:90.

In certain embodiments, the amino acid sequence of the polypeptide has an HMM score greater than about 790, using an HMM generated from the amino acid sequences depicted in FIG. 5, wherein the polypeptide comprises a B3 DNA binding domain and an auxin response factor.

In another aspect, a method comprises introducing into a plant cell an exogenous nucleic acid that comprises a regulatory region operably linked to a nucleotide sequence encoding a polypeptide having 80 percent or greater sequence identity to an amino acid sequence set forth in SEQ ID NO:2, 20, 74, 93 or 112. A plant and/or plant tissue produced from the plant cell has a difference in the level of cold tolerance as compared to the corresponding level of cold tolerance of a control plant that does not comprise the exogenous nucleic acid.

In another aspect, a method comprises introducing into a plant cell an exogenous nucleic acid, that comprises a regulatory region operably linked to a nucleotide sequence having 80 percent or greater sequence identity to a nucleotide sequence set forth in SEQ ID NO:1, 19, 92, 97, or 111, or a fragment thereof. A plant and/or plant tissue produced from the plant cell has a difference in the level of cold tolerance as compared to the corresponding level of cold tolerance of a control plant that does not comprise the exogenous nucleic acid.

Methods of modulating the level of cold tolerance in a plant are provided herein. In one aspect, a method comprises introducing into a plant cell an exogenous nucleic acid, that comprises a regulatory region operably linked to a nucleotide sequence encoding a trans-activating small-interfering RNA (tasiRNA) that acts upon, e.g. suppresses expression of, an auxin responsive factor (ARF) polypeptide. The HMM bit score of the amino acid sequence of the ARF polypeptide is greater than about 790, using an HMM generated from the amino acid sequences depicted in FIG. 5. A plant and/or plant tissue produced from the plant cell has a difference in the level of cold tolerance as compared to the corresponding level of cold tolerance of a control plant that does not comprise the exogenous nucleic acid.

Plant cells comprising an exogenous nucleic acid are provided herein. In one aspect, the exogenous nucleic acid comprises a regulatory region operably linked to a nucleotide sequence encoding a tasiRNA. In some embodiments, the nucleotide sequence comprises a tasiRNA coding region having 80 percent or greater sequence identity to a nucleic acid sequence selected from the group consisting of residues 305 to about 346 of SEQ ID NO:111, residues 21 to about 62 of SEQ ID NO:66, residues 20 to about 61 of SEQ ID NO:67, residues 21 to about 62 of SEQ ID NO:72, residues 21 to about 62 of SEQ ID NO:73, residues 77 to about 118 of SEQ ID NO:144, residues 292 to about 313 of SEQ ID NO:145, residues 37 to about 78 of SEQ ID NO:146, residues 56 to about 97 of SEQ ID NO:147, residues 37 to about 78 of SEQ ID NO:148, residues 45 to about 86 of SEQ ID NO:149, residues 46 to about 98 of SEQ ID NO:150, residues 476 to about 497 of SEQ ID NO:151, residues 21 to about 62 of SEQ ID NO:152, residues 21 to about 62 of SEQ ID NO:153, residues 21 to about 62 of SEQ ID NO:154, residues 21 to about 62 of SEQ ID NO:155, and residues 21 to about 62 of SEQ ID NO:156, wherein a plant produced from said plant cell has a difference in the level of cold tolerance as compared to the corresponding level of cold tolerance of a control plant that does not comprise said nucleic acid. Transgenic plants comprising such plant cells are provided herein. In some embodiments, the transgenic plant comprises an exogenous nucleic acid having a sequence selected from the group consisting of SEQ ID NO:66, 67, 72, 73, 111, 144, 145, 146, 147, 148, 149, 150, 151, 152, 153, 154, 155, and 156.

Methods of producing a plant and/or plant tissue are provided herein. In one aspect, a method comprises introducing into a plant cell an exogenous nucleic acid, said exogenous nucleic acid comprising a regulatory region operably linked to a nucleotide sequence encoding a gene suppressing tasiRNA, said nucleotide sequence comprising a tasiRNA coding region having 80 percent or greater sequence identity to a nucleic acid sequence selected from the group consisting of residues 305 to about 346 of SEQ ID NO:111, residues 21 to about 62 of SEQ ID NO:66, residues 20 to about 61 of SEQ ID NO:67, residues 21 to about 62 of SEQ ID NO:72, residues 21 to about 62 of SEQ ID NO:73, residues 77 to about 118 of SEQ ID NO:144, residues 292 to about 313 of SEQ ID NO:145, residues 37 to about 78 of SEQ ID NO:146, residues 56 to about 97 of SEQ ID NO:147, residues 37 to about 78 of SEQ ID NO:148, residues 45 to about 86 of SEQ ID NO:149, residues 46 to about 98 of SEQ ID NO:150, residues 476 to about 497 of SEQ ID NO:151, residues 21 to about 62 of SEQ ID NO:152, residues 21 to about 62 of SEQ ID NO:153, residues 21 to about 62 of SEQ ID NO:154, residues 21 to about 62 of SEQ ID NO:155, and residues 21 to about 62 of SEQ ID NO:156, wherein a plant produced from said plant cell has a difference in the level of cold tolerance as compared to the corresponding level of cold tolerance of a control plant that does not comprise said nucleic acid. In certain embodiments, the expression of a target ARF gene is suppressed in a plant. In some embodiments, the ARF gene encodes a polypeptide having 80 percent or greater sequence identity to an amino acid sequence selected from the group consisting of SEQ ID NO:112, 114, 116, 117, 118, 119, 120, 121, 122, 123, 124, 125, 126, 127, 128, 130, 131, 132, 134, 136, 137, 138, 139, 141, and 143. In other embodiments, the ARF gene encodes a polypeptide and the HMM bit score of the amino acid sequence of said polypeptide is greater than about 790, said HMM based on the amino acid sequences depicted in FIG. 5. In other embodiments, the gene suppressing tasiRNA or its complement is complementary to RNA transcribed from said target ARF gene. In other embodiments, the nucleotide sequence encoding a gene suppressing tasiRNA comprises a microRNA recognition site having 80 percent or greater sequence identity to a nucleic acid sequence selected from the group consisting of residues 109 to about 129 of SEQ ID NO:66, residues 114 to about 135 of SEQ ID NO:67, residues 119 to about 139 of SEQ ID NO:72, residues 108 to about 128 of SEQ ID NO:73, residues 234 to about 254 of SEQ ID NO:144, residues 135 to about 176 of SEQ ID NO:145, residues 173 to about 189 of SEQ ID NO:147, residues 154 to about 170 of SEQ ID NO:148, residues 134 to about 157 of SEQ ID NO:149, residues 154 to about 198 of SEQ ID NO:150, residues 319 to about 360 of SEQ ID NO:151, residues 121 to about 141 of SEQ ID NO:152, residues 120 to about 140 of SEQ ID NO:153, residues 121 to about 141 of SEQ ID NO:154, residues 121 to about 141 of SEQ ID NO:155, residues 121 to about 141 of SEQ ID NO:156, and residues 462 to about 483 of SEQ ID NO:111.

Plant cells comprising an exogenous nucleic acid are provided herein. In one aspect, the exogenous nucleic acid comprises a regulatory region operably linked to a nucleotide sequence encoding a polypeptide. The HMM bit score of the amino acid sequence of the polypeptide is greater than about 130, using an HMM based on the amino acid sequences depicted in one of FIG. 1, 2, 3, or 4. The plant and/or plant cells has a difference in the level of cold tolerance as compared to the corresponding level of cold tolerance of a control plant that does not comprise the exogenous nucleic acid. In another aspect, the exogenous nucleic acid comprises a regulatory region operably linked to a nucleotide sequence encoding a polypeptide having 80 percent or greater sequence identity to an amino acid sequence selected from the group consisting of SEQ ID NO:2, 20, 93, or 74. A plant and/or plant tissue produced from the plant cell has a difference in the level of cold tolerance as compared to the corresponding level of cold tolerance of a control plant that does not comprise the exogenous nucleic acid. In another aspect, the exogenous nucleic acid comprises a regulatory region operably linked to a nucleotide sequence having 80 percent or greater sequence identity to a nucleotide sequence selected from the group consisting of SEQ ID NO:1, 19, 92, 97, or 111. A plant and/or plant tissue produced from the plant cell has a difference in the level of cold tolerance as compared to the corresponding level of cold tolerance of a control plant that does not comprise the exogenous nucleic acid. A transgenic plant comprising such a plant cell is also provided. Also provided is a seed product. The product comprises embryonic tissue from a transgenic plant.

Isolated nucleic acids are also provided. In one aspect, an isolated nucleic acid comprises a nucleotide sequence having 80% or greater sequence identity to the nucleotide sequence set forth in SEQ ID NO:3, 5, 7, 9, 11, 14, 16, 21, 23, 25, 27, 33, 35, 37, 39, 41, 55, 57, 70, 75, 80, 84, 87, 91, 92, 97, 105, 113, 115, 129, 133, 140, or 142.

In another aspect, an isolated nucleic acid comprises a nucleotide sequence encoding a polypeptide having 80% or greater sequence identity to the amino acid sequence set forth in SEQ ID NO:4, 6, 8, 10, 12, 22, 24, 26, 28, 36, 38, 40, 42, 71, 74, 85, 88, 93, 105, 114, 116, 130, 134, 136, 141, or 143.

In another aspect, methods of identifying a genetic polymorphism associated with variation in the level of cold tolerance are provided. The methods include providing a population of plants, and determining whether one or more genetic polymorphisms in the population are genetically linked to the locus for a polypeptide selected from the group consisting of the polypeptides depicted in FIGS. 1, 2, 3, and 4 and functional homologs thereof, such as, but not limited to, those identified in the Sequence Listing. The correlation between variation in the level of cold tolerance in a tissue in plants of the population and the presence of the one or more genetic polymorphisms in plants of the population is measured, thereby permitting identification of whether or not the one or more genetic polymorphisms are associated with such variation.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

FIG. 1 is an alignment of Ceres SEEDLINE ID no.ME00327 with homologous and/or orthologous amino acid sequences Ceres SEEDLINE ID no.ME00327 (SEQ ID NO:2), Ceres CLONE ID no.1915941 (SEQ ID NO:8), Ceres ANNOT ID no.1461830 (SEQ ID NO:10), Ceres CLONE ID no.1080942 (SEQ ID NO:15), and Ceres CLONE ID no.1073190 (SEQ ID NO:17). In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

Figure 2:
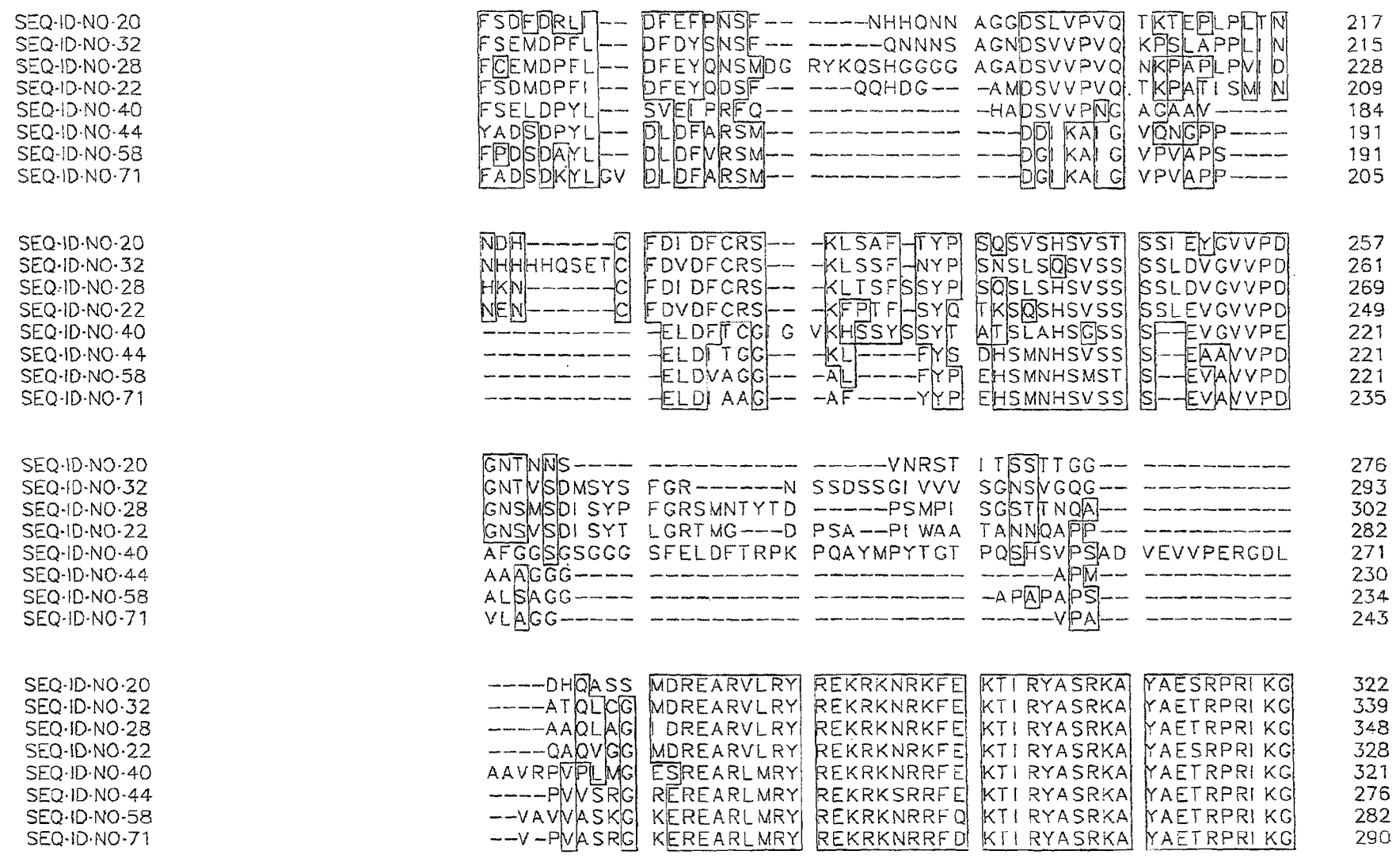
Figure 2:
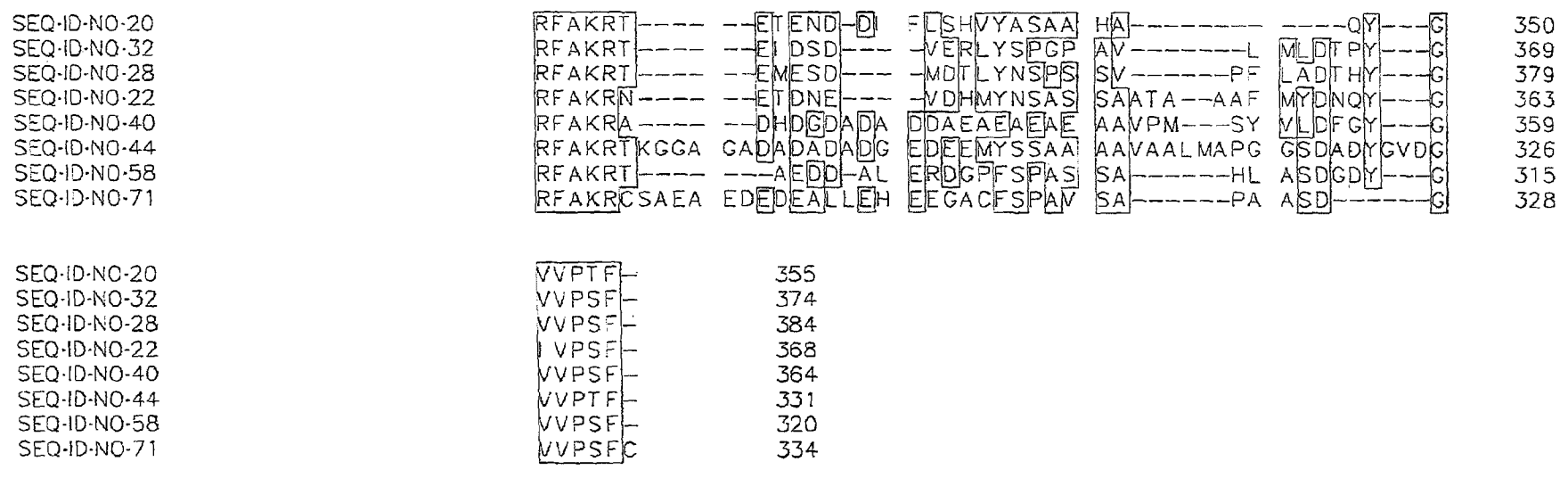

FIG. 2 is an alignment of Ceres SEEDLINE ID no.ME04315 (SEQ ID NO:20) with homologous and/or orthologous amino acid sequences Ceres CLONE ID no.1842825 (SEQ ID NO:22), Ceres ANNOT ID no.1482536 (SEQ ID NO:28), Ceres CLONE ID no.463157 (SEQ ID NO:32), Ceres CLONE ID no.1674443 (SEQ ID NO:40), GI ID no.116310719 (SEQ ID NO:44), Ceres CLONE ID no.907473 (SEQ ID NO:58), and Ceres CLONE ID no.1755065 (SEQ ID NO:71).

FIG. 3 is an alignment of full length homologous and/or orthologous amino acid sequences of Ceres SEEDLINE ID no.ME17294 (SEQ ID NO:93), including Ceres CLONE ID no.473040 (SEQ ID NO:79), Ceres CLONE ID no.922223 (SEQ ID NO:81), GI ID no.125528967 (SEQ ID NO:82), GI ID no.125573200 (SEQ ID NO:83), Ceres ANNOT ID no.1527409 (SEQ ID NO:85), GI ID no.92871098 (SEQ ID NO:86), Ceres CLONE ID no.1831117 (SEQ ID NO:88), and Ceres ANNOT ID no.857222 (SEQ ID NO:90).

FIG. 4 is an alignment of a truncated version of Ceres SEEDLINE ID no.ME17294 (SEQ ID NO:93) with homologous and/or orthologous amino acid truncated sequences, Ceres CLONE ID no.1831117 (SEQ ID NO:95), Ceres CLONE ID no.1844076 (SEQ ID NO:98), Ceres CLONE ID no.473040 (SEQ ID NO:104), Ceres CLONE ID no.922223 (SEQ ID NO:106), and GI ID no.125528967 (SEQ ID NO:107).

FIG. 5 is an alignment of functional homologs of the ARF (Auxin Response Factor) genes ARF2, ARF3, and ARF4, including LOCUS ID no. AT5G62000 (SEQ ID NO:112), Ceres ANNOT ID no.1527370 (SEQ ID NO:114), Ceres ANNOT ID no.1473961 (SEQ ID NO:116), GI ID no.62319853 (SEQ ID NO:117), GI ID no.62319903 (SEQ ID NO:118), GI ID no.47716275 (SEQ ID NO:119), GI ID no.125534572 (SEQ ID NO:120), GI ID no.26251300 (SEQ ID NO:121), GI ID no.115441981 (SEQ ID NO:123), GI ID no.23893346 (SEQ ID NO:124), GI ID no.115485689 (SEQ ID NO:125), GI ID no.108864435 (SEQ ID NO:126), GI ID no.50511471 (SEQ ID NO:127), LOCUS ID no. At2g33860 (SEQ ID NO:128), GI ID no.2245390 (SEQ ID NO:131), GI ID no.3228517 (SEQ ID NO:132), Ceres CLONE ID no.827306 (SEQ ID NO:134), Ceres CLONE ID no.1598488 (SEQ ID NO:136), GI ID no.125553314 (SEQ ID NO:138), and Ceres CLONE ID no.462443 (SEQ ID NO:143).

DETAILED DESCRIPTION

The invention features methods and materials related to modulating cold tolerance levels in plants. In some embodiments, the cold tolerance plants of the invention, under cold stress and/or cold flux conditions, have modulated levels of growth, cold acclimation, and/or cold damage. The methods can include transforming a plant cell with a nucleic acid encoding a cold tolerance modulating polypeptide, wherein expression of the polypeptide results in a modulated level of cold tolerance. Plant cells produced using such methods can be grown to produce plants having an increased cold tolerance. Such plants, and the seeds of such plants, may be used to produce, for example, plants and/or plant tissues having increased biomass.

I. Definitions

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Cold." Plant species vary in their capacity to tolerate low temperatures. Chilling-sensitive plant species, including many agronomically important species, can be injured by cold, above-freezing temperatures. At temperatures below the freezing-point of water most plant species will be damaged. Thus, "cold" can be defined as the temperature at which a given plant species will be adversely affected as evidenced by symptoms such as decreased photosynthesis and membrane damage (measured by electrolyte leakage). Since plant species vary in their capacity to tolerate cold, the precise environmental conditions that cause cold stress cannot be generalized. However, cold tolerant plants are characterized by their ability to retain their normal appearance, recover quickly from low temperature conditions, exhibit normal or increased growth under low temperature conditions, and/or have improved cold acclimation. Such cold tolerant plants produce higher biomass and/or yield than plants that are not cold tolerant. Differences in physical appearance, recovery and yield can be quantified and statistically analyzed using well known measurement and analysis methods.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Panicum virgatum* plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of a cold tolerance refers to the change in the level of the indicated compound or constituent that is observed as a result of expression of, or transcription from, an exogenous nucleic acid in a plant cell. The change in level is measured relative to the corresponding level in control plants.

"Nucleic acid" and "polynucleotide" are used interchangeably herein, and refer to both RNA and DNA, including cDNA, genomic DNA, synthetic DNA, and DNA or RNA containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. Polypeptides

Polypeptides described herein include cold tolerance-modulating polypeptides. Cold tolerance-modulating polypeptides can be effective to modulate cold tolerance levels when expressed in a plant or plant cell. Such polypeptides typically contain at least one domain indicative of cold tolerance-modulating polypeptides, as described in more detail herein. Cold tolerance-modulating polypeptides typically have an HMM bit score that is greater than 130, as described in more detail herein. In some embodiments, cold tolerance-modulating polypeptides have greater than 80% identity to SEQ ID NOs: 2, 20, 74, 93 or 112, as described in more detail herein.

A. Domains Indicative of Cold Tolerance-Modulating Polypeptides

A cold tolerance-modulating polypeptide can contain a B-box zinc finger domain. The B-box zinc finger domain is often found associated with CCT motif. SEQ ID NO:20 sets forth the amino acid sequence of an *Arabidopsis* clone, identified herein as Ceres SEEDLINE ID no.ME04315 (SEQ ID NO:20), that is predicted to encode a polypeptide containing a CCT motif and a B-box zinc finger domain. A B-box zinc finger domain is typically around 40 amino acids in length. This motif is generally associated with a finger. It is found, for example, in transcription factors, ribonucleoproteins and protooncoproteins. It has been shown to be essential but not sufficient to localize the PML protein in a punctate pattern in interphase nuclei. Among the 7 possible ligands for the zinc atom contained in a B-box, only 4 are used and bind one zinc atom in a Cys2-His2 tetrahedral arrangement. The NMR analysis reveals that the B-box structure comprises two beta-strands, two helical turns and three extended loop regions different from any other zinc binding motif. A CCT motif can be found in a number of plant proteins. It is rich in basic amino acids and has been called a CCT motif after Co, Col and Toc1. The CCT motif is about 45 amino acids long and contains a putative nuclear localization signal within the second half of the CCT motif. Toc1 mutants have been identified in this region. The CCT (CONSTANS, CO-like, and TOC1) domain is a highly conserved basic module of ~43 amino acids, which is found near the C-terminus of plant proteins. The CCT domain is often found in association with other domains, such as the B-box zinc finger, the GATA-type zinc finger, the ZIM motif or the response regulatory domain. The CCT domain contains a putative nuclear localization signal within the second half of the CCT motif and has been shown to be involved in nuclear localization and probably also has a role in protein-protein interaction.

In embodiments of the invention, a cold tolerance-modulating polypeptide can comprise a CCT motif having 80% or greater sequence identity to amino acid residues 285 to 329 of SEQ ID NO:20, residues 291 to 335 of SEQ ID NO:22, residues 235 to 279 of SEQ ID NO:24, residues 217 to 261 of SEQ ID NO:26, residues 311 to 355 of SEQ ID NO:28, residues 285 to 329 of SEQ ID NO:29, residues 281 to 325 of SEQ ID NO:30, residues 302 to 346 of SEQ ID NO:32, residues 289 to 333 of SEQ ID NO:34, residues 295 to 339 of SEQ ID NO:36, residues 261 to 305 of SEQ ID NO:38, residues 284 to 328 of SEQ ID NO:40, residues 288 to 332 of SEQ ID NO:42, residues 261 to 305 of SEQ ID NO:43, residues 239 to 283 of SEQ ID NO:44, residues 294 to 338 of SEQ ID NO:45, residues 279 to 323 of SEQ ID NO:46, residues 261 to 305 of SEQ ID NO:47, residues 239 to 283 of SEQ ID NO:48, residues 294 to 338 of SEQ ID NO:49, residues 261 to 305 of SEQ ID NO:50, residues 298 to 342 of SEQ ID NO:51, residues 241 to 285 of SEQ ID NO:52, residues 268 to 312 of SEQ ID NO:53, residues 245 to 289 of SEQ ID NO:54, residues 238 to 282 of SEQ ID NO:56, residues 245 to 289 of SEQ ID NO:58, residues 279 to 323 of SEQ ID NO:59, residues 236 to 280 of SEQ ID NO:60, residues 250 to 294 of SEQ ID NO:61, residues 322 to 366 of SEQ ID NO:62, residues 297 to 341 of SEQ ID NO:63, residues 348 to 392 of SEQ ID NO:64, residues 312 to 356 of SEQ ID NO:65, residues 340 to 384 of SEQ ID NO:68, residues 307 to 351 of SEQ ID NO:69, or residues 253 to 297 of SEQ ID NO:71.

In embodiments of the invention, a cold tolerance-modulating polypeptide can comprise a B-box zinc finger domain having 80% or greater sequence identity to amino acid residues 56 to 103 of SEQ ID NO:20, residues 62 to 109 of SEQ ID NO:22, residues 64 to 106 of SEQ ID NO:24, residues 34 to 81 of SEQ ID NO:26, residues 63 to 110 of SEQ ID NO:28, residues 56 to 103 of SEQ ID NO:29, residues 56 to 103 of SEQ ID NO:30, residues 60 to 107 of SEQ ID NO:32, residues 56 to 103 of SEQ ID NO:34, residues 51 to 98 of SEQ ID NO:36, residues 70 to 112 of SEQ ID NO:38, residues 51 to 98 of SEQ ID NO:40, residues 52 to 99 of SEQ ID NO:42, residues 72 to 114 of SEQ ID NO:43, residues 62 to 104 of SEQ ID NO:44, residues 50 to 97 of SEQ ID NO:45, residues 55 to 102 of SEQ ID NO:46, residues 72 to 114 of SEQ ID NO:47, residues 62 to 104 of SEQ ID NO:48, residues 50 to 97 of SEQ ID NO:49, residues 27 to 71 of SEQ ID NO:50, residues 60 to 107 of SEQ ID NO:51, residues 1 to 48 of SEQ ID NO:52, residues 1 to 48 of SEQ ID NO:53, residues 1 to 48 of SEQ ID NO:54, residues 62 to 104 of SEQ ID NO:56, residues 64 to 106 of SEQ ID NO:58, residues 1 to 48 of SEQ ID NO:59, residues 61 to 103 of SEQ ID NO:60, residues 70 to 112 of SEQ ID NO:61, residues 52 to 99 of SEQ ID NO:62, residues 51 to 98 of SEQ ID NO:63, residues 77 to 119 of SEQ ID NO:64, residues 59 to 106 of SEQ ID NO:65, residues 59 to 106 of SEQ ID NO:68, residues 34 to 66 of SEQ ID NO:69, or residues 64 to 106 of SEQ ID NO:71.

A cold tolerance-modulating polypeptide can contain a short-chain dehydrogenase domain. The motif is present in SEQ ID NO:93, which sets forth the amino acid sequence of an *Arabidopsis* clone, identified herein as Ceres SEEDLINE ID no.ME17294 (SEQ ID NO:93), that is predicted to encode a polypeptide containing a short-chain dehydrogenase domain. The short-chain dehydrogenases/reductases family (SDR) is a very large family of enzymes, most of which are known to be NAD- or NADP-dependent oxidoreductases. As the first member of this family to be characterized was *Drosophila* alcohol dehydrogenase, this family used to be called 'insect-type', or 'short-chain' alcohol dehydrogenases. Most members of this family are proteins of about 250 to 300 amino acid residues.

In embodiments of the invention, a cold tolerance-modulating polypeptide can comprise a short-chain dehydrogenase domain having 80% or greater identity to amino acid residues 38 to 173 of SEQ ID NO:74, residues 37 to 174 of SEQ ID NO:76, residues 23 to 160 of SEQ ID NO:77, residues 7 to 168 of SEQ ID NO:79, residues 43 to 179 of SEQ ID NO:81, residues 49 to 188 of SEQ ID NO:82, residues 48 to 187 of SEQ ID NO:83, residues 37 to 172 of SEQ ID NO:85, residues 35 to 170 of SEQ ID NO:86, residues 20 to 160 of SEQ ID NO:88, or residues 37 to 174 of SEQ ID NO:90.

In some embodiments, a cold tolerance-modulating polypeptide is truncated at the amino- or carboxy-terminal end of a naturally occurring polypeptide. A truncated polypeptide may retain certain domains of the naturally occurring polypeptide while lacking others. Thus, length variants that are up to 5, 10, 15, 20, 25, 30, 35, 40, 45, 50, 55, 60, 65, 70, 75, 80, 85, 90, 95, 100, 105, 110, 115, 120, 125, 130, 135, 140, 145, 150, 155, 160, 165, or 170 amino acids shorter or longer typically exhibit the cold tolerance-modulating activity of a truncated polypeptide. In some embodiments, a truncated polypeptide is a dominant negative polypeptide. SEQ ID NO:93 sets forth the amino sequence of a cold tolerance-modulating polypeptide that is truncated at the amino-terminal end relative to a naturally occurring polypeptide. Expression in a plant and/or plant tissue of such a truncated polypeptide confers a difference in the level of cold tolerance in a plant and/or tissue of the plant as compared to the corresponding level in tissue of a control plant.

B. Functional Homologs Identified by Reciprocal BLAST

In some embodiments, one or more functional homologs of a reference cold tolerance-modulating polypeptide defined by one or more of the Pfam descriptions indicated above are suitable for use as cold tolerance-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a cold tolerance-modulating polypeptide, or by combining domains from the coding sequences for different naturally-occurring cold tolerance-modulating polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of cold tolerance-modulating polypeptides. Sequence analysis can involve BLAST, Reciprocal BLAST, or PSI-BLAST analysis of nonredundant databases using a cold tolerance-modulating polypeptide amino acid sequence as the reference sequence. Amino acid sequence is, in some instances, deduced from the nucleotide sequence. Those polypeptides in the database that have greater than 40% sequence identity are candidates for further evaluation for suitability as a cold tolerance-modulating polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in cold tolerance-modulating polypeptides, e.g., conserved functional domains.

Conserved regions can be identified by locating a region within the primary amino acid sequence of a cold tolerance-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Examples of amino acid sequences of functional homologs of the polypeptide set forth in SEQ ID NO:2 are provided in FIG. 1 and in the Sequence Listing. Such exemplary functional homologs include Ceres CLONE ID no.1897908 (SEQ ID NO:4), Ceres CLONE ID no.1938030 (SEQ ID NO:6), Ceres CLONE ID no.1915941 (SEQ ID NO:8), Ceres ANNOT ID no.1461830 (SEQ ID NO:10), Ceres ANNOT ID no.1439985 (SEQ ID NO:12), GI ID no.15241794 (SEQ ID NO:13), Ceres CLONE ID no.1080942 (SEQ ID NO:15), and Ceres CLONE ID no.1073190 (SEQ ID NO:17). In some cases, a functional homolog of SEQ ID NO:2 has an amino acid sequence with at least 20% sequence identity, e.g., 25%, 30%, 35%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:2.

Examples of amino acid sequences of functional homologs of the polypeptide set forth in SEQ ID NO:20 are provided in FIG. 2 and in the Sequence Listing. Such exemplary functional homologs include Ceres CLONE ID no.1842825 (SEQ ID NO:22), Ceres CLONE ID no.1834027 (SEQ ID NO:24), Ceres CLONE ID no.1837064 (SEQ ID NO:26), Ceres ANNOT ID no.1482536 (SEQ ID NO:28), GI ID no.18424009 (SEQ ID NO:29), GI ID no.9759262 (SEQ ID NO:30), Ceres CLONE ID no.463157 (SEQ ID NO:32), Ceres CLONE ID no.685991 (SEQ ID NO:34), Ceres CLONE ID no.702632 (SEQ ID NO:36), Ceres CLONE ID no.1559496 (SEQ ID NO:38), Ceres CLONE ID no.1674443 (SEQ ID NO:40), Ceres CLONE ID no.1828897 (SEQ ID NO:42), GI ID no.125540249 (SEQ ID NO:43), GI ID no.116310719 (SEQ ID NO:44), GI ID no.125556324 (SEQ ID NO:45), GI ID no.125538317 (SEQ ID NO:46), GI ID no.115447239 (SEQ ID NO:47), GI ID no.115459216 (SEQ ID NO:48), GI ID no.115469296 (SEQ ID NO:49), GI ID no.125582846 (SEQ ID NO:50), GI ID no.92875402 (SEQ ID NO:51), GI ID no.3341723 (SEQ ID NO:52), GI ID no.4091806 (SEQ ID NO:53), GI ID no.60459257 (SEQ ID NO:54), Ceres CLONE ID no.1756710 (SEQ ID NO:56), Ceres CLONE ID no.907473 (SEQ ID NO:58), GI ID no.4091804 (SEQ ID NO:59), GI ID no.21667487 (SEQ ID NO:60), GI ID no.21655154 (SEQ ID NO:61), GI ID no.45544883 (SEQ ID NO:62), GI ID no.21655166 (SEQ ID NO:63), GI ID no.10946337 (SEQ ID NO:64), GI ID no.90657642 (SEQ ID NO:65), GI ID no.45544887 (SEQ ID NO:68), GI ID no.47606678 (SEQ ID NO:69), or Ceres CLONE ID no.1755065 (SEQ ID NO:71). In some cases, a functional homolog of SEQ ID NO:20 has an amino acid sequence with at least 20% sequence identity, e.g., 25%, 30%, 35%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:20.

Examples of amino acid sequences of full length functional homologs of the truncated polypeptide set forth in SEQ ID NO:93 are provided in FIG. 3 and in the Sequence Listing. Such exemplary functional homologs include Ceres CLONE ID no.1844076 (SEQ ID NO:74), Ceres CLONE ID no.35974 (SEQ ID NO:76), GI ID no.10176876 (SEQ ID NO:77), Ceres CLONE ID no.473040 (SEQ ID NO:79), Ceres CLONE ID no.922223 (SEQ ID NO:81), GI ID no.125528967 (SEQ ID NO:82), GI ID no.125573200 (SEQ ID NO:83), Ceres ANNOT ID no.1527409 (SEQ ID NO:85), GI ID no.92871098 (SEQ ID NO:86), Ceres CLONE ID no.1831117 (SEQ ID NO:88), and Ceres ANNOT ID no.857222 (SEQ ID NO:90). In some cases, a full length functional homolog of SEQ ID NO:93 has an amino acid sequence with at least 20% sequence identity, e.g., 25%, 30%, 35%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:74, 76, 77, 79, 81, 82, 83, 85, 86, 88, 90, or 93.

Examples of amino acid sequences of functional homologs of the polypeptide set forth in SEQ ID NO:93 are provided in FIG. 4 and in the Sequence Listing. Such exemplary functional homologs include Ceres ANNOT ID no.857222 (SEQ ID NO:110), Ceres CLONE ID no.1831117 (SEQ ID NO:95), GI ID no.92871098 (SEQ ID NO:96), Ceres CLONE ID no.1844076 (SEQ ID NO:98), Ceres CLONE ID no.35974 (SEQ ID NO:100), GI ID no.110737329 (SEQ ID NO:101), GI ID no.10176876 (SEQ ID NO:102), Ceres CLONE ID no.473040 (SEQ ID NO:104), Ceres CLONE ID no.922223 (SEQ ID NO:106), GI ID no.125528967 (SEQ ID NO:107), and GI ID no.115442007 (SEQ ID NO:108). In some cases, a functional homolog of SEQ ID NO:93 has an amino acid sequence with at least 20% sequence identity, e.g., 25%, 30%, 35%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:93.

Figure 5:
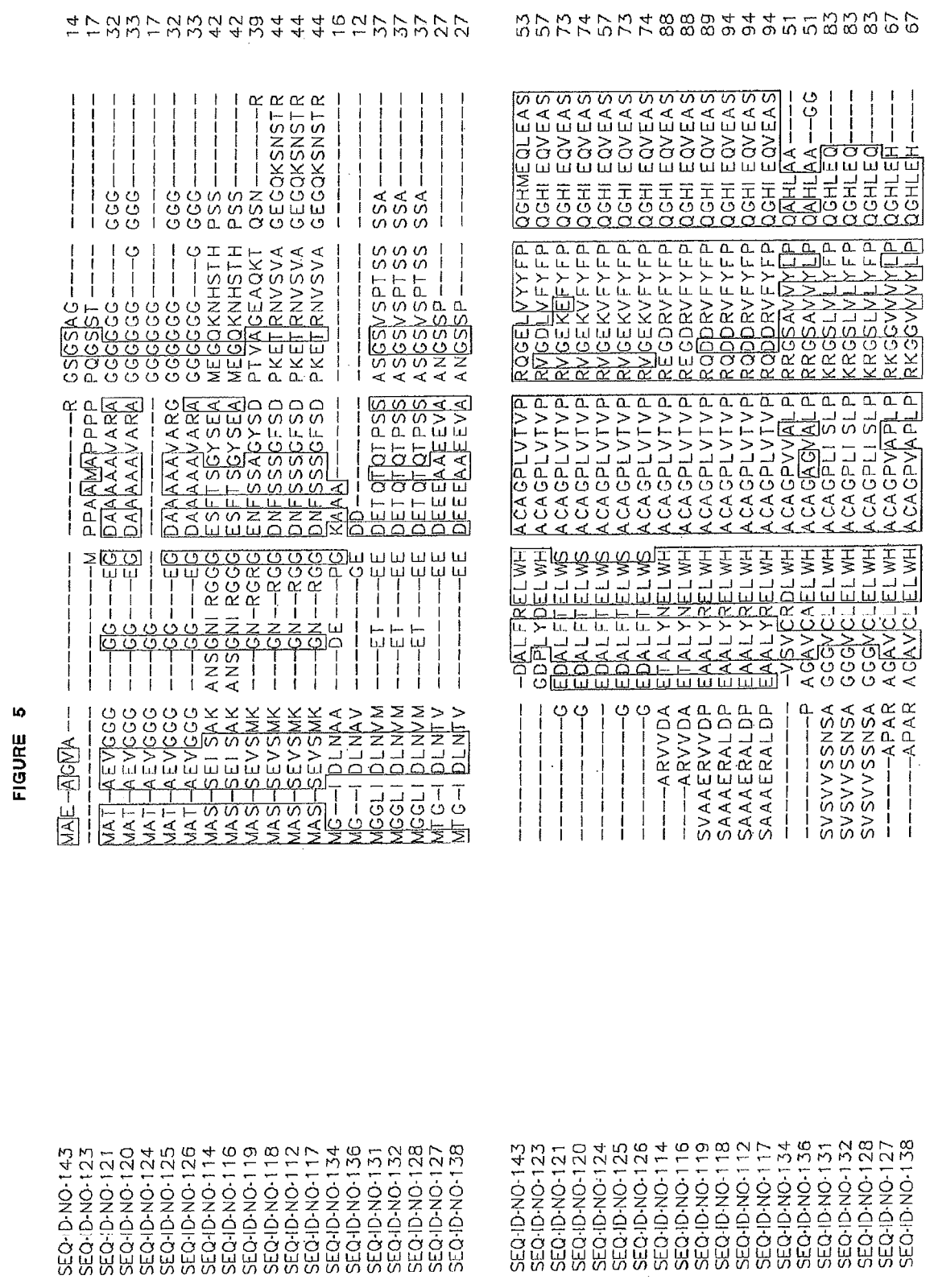
Figure 5:
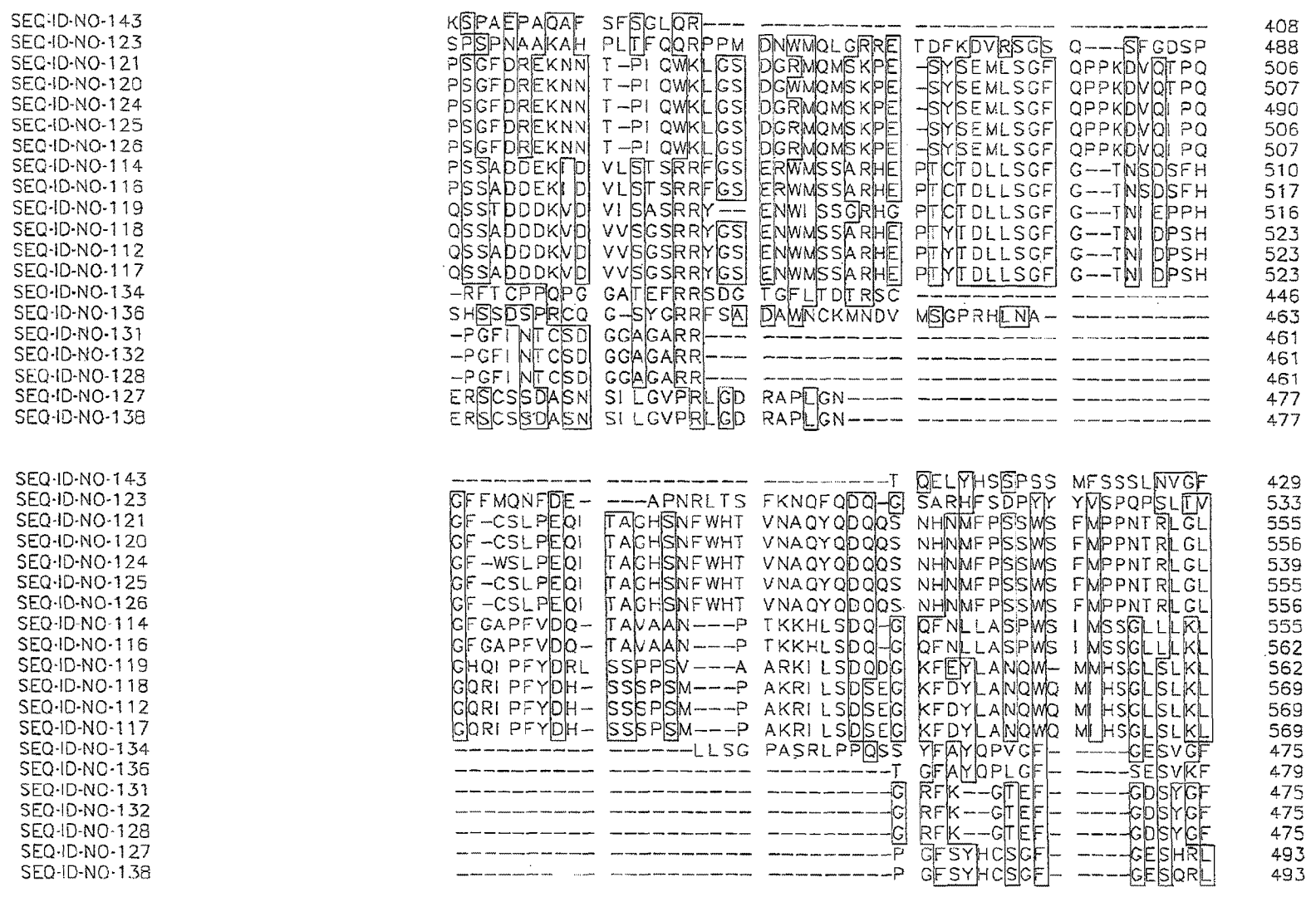
Figure 5:
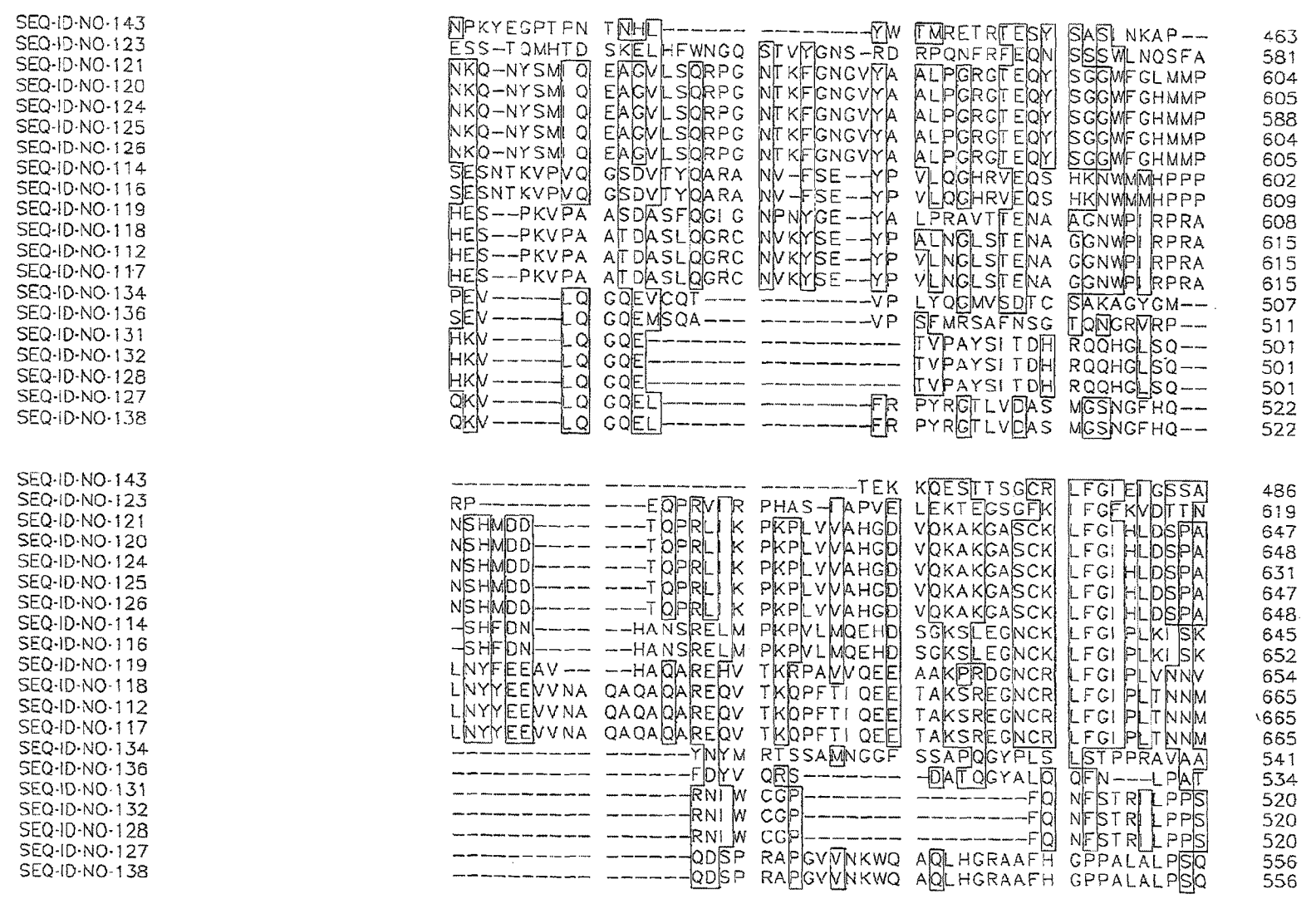
Figure 5:
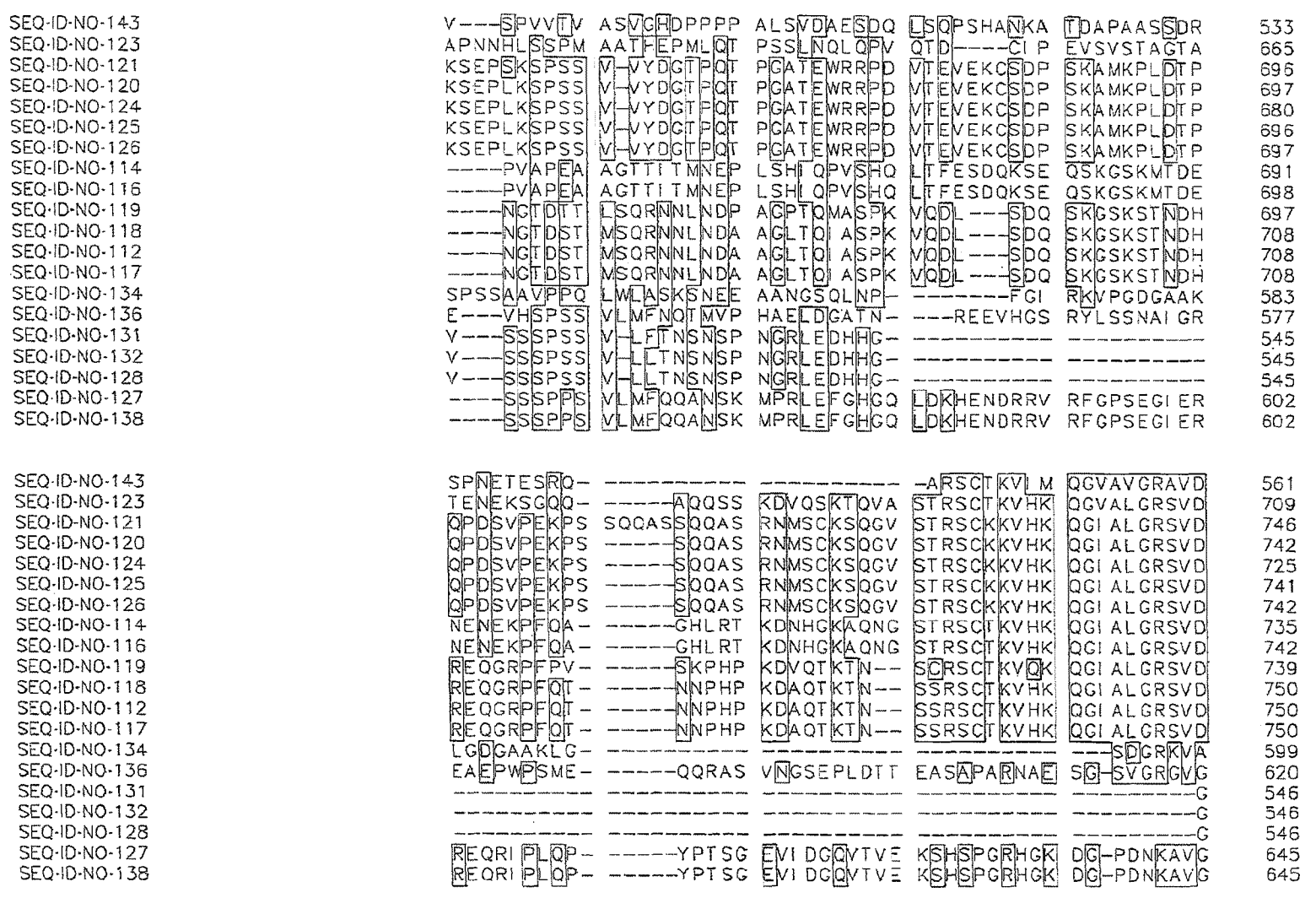

Examples of amino acid sequences of functional homologs of the polypeptide set forth in SEQ ID NO:116 are provided in FIG. 5 and in the Sequence Listing. Such exemplary functional homologs include LOCUS ID no. AT5G62000 (SEQ ID NO:112), Ceres ANNOT ID no.1527370 (SEQ ID NO:114), GI ID no.62319853 (SEQ ID NO:117), GI ID no.62319903 (SEQ ID NO:118), GI ID no.47716275 (SEQ ID NO:119), GI ID no.125534572 (SEQ ID NO:120), GI ID no.26251300 (SEQ ID NO:121), GI ID no.125528952 (SEQ ID NO:122), GI ID no.115441981 (SEQ ID NO:123), GI ID no.23893346 (SEQ ID NO:124), GI ID no.115485689 (SEQ ID NO:125), GI ID no.108864435 (SEQ ID NO:126), GI ID no.50511471 (SEQ ID NO:127), LOCUS ID no. At2g33860 (SEQ ID NO:128), Ceres ANNOT ID no.1536494 (SEQ ID NO:130), GI ID no.2245390 (SEQ ID NO:131), GI ID no.3228517 (SEQ ID NO:132), Ceres CLONE ID no.827306 (SEQ ID NO:134), Ceres CLONE ID no.1598488 (SEQ ID NO:136), GI ID no.125527740 (SEQ ID NO:137), GI ID no.125553314 (SEQ ID NO:138), LOCUS ID no. At5g60450 (SEQ ID NO:139), Ceres ANNOT ID no.1515383 (SEQ ID NO:141), and Ceres CLONE ID no.462443 (SEQ ID NO:143). In some cases, a functional homolog of SEQ ID NO:116 has an amino acid sequence with at least 20% sequence identity, e.g., 25%, 30%, 35%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:116.

Examples of nucleic acid sequences of functional homologs of the tasiRNA encoding nucleic acid sequence set forth in SEQ ID NO:111 are found in the Sequence Listing. Such exemplary functional homologs include 66, 67, 72, 73, 144, 145, 146, 147, 148, 149, 150, 151, 152, 153, 154, 155, and 156. In some cases, a functional homolog of SEQ ID NO:111 has an nucleic acid sequence with at least 20% sequence identity, e.g., 25%, 30%, 35%, 40%, 45%, 50%, 52%, 56%, 59%, 61%, 65%, 70%, 75%, 80%, 85%, 90%, 95%, 97%, 98%, or 99% sequence identity, to the nucleic acid sequence set forth in SEQ ID NO:111.

The identification of conserved regions in a cold tolerance-modulating polypeptide facilitates production of variants of cold tolerance-modulating polypeptides. Variants of cold tolerance-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIG. 1, FIG. 2, FIG. 3, or FIG. 4 and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

C. Functional Homologs Identified by HMMER

In some embodiments, useful cold tolerance-modulating polypeptides include those that fit a Hidden Markov Model based on the polypeptides set forth in any one of FIGS. 1-4 or ARFs that are acted upon by tasiRNA (FIG. 5). A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, --consistency REPS of 2; -ir, --iterative-refinement REPS of 100; -pre, --pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate cold tolerance-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The cold tolerance-modulating polypeptides discussed below fit the indicated HMM with an HMM bit score greater than 20 (e.g., greater than 30, 40, 50, 60, 70, 80, 90, 100, 200, 300, 400, or 500). In some embodiments, the HMM bit score of a cold tolerance-modulating polypeptide discussed below is about 50%, 60%, 70%, 80%, 90%, or 95% of the HMM bit score of a functional homolog provided in the Sequence Listing of this application. In some embodiments, a cold tolerance-modulating polypeptide discussed below fits the indicated HMM with an HMM bit score greater than 20, and has a domain indicative of a cold tolerance-modulating polypeptide. In some embodiments, a cold tolerance-modulating polypeptide discussed below fits the indicated HMM with an HMM bit score greater than 20, and has 70% or greater sequence identity (e.g., 75%, 80%, 85%, 90%, 95%, or 100% sequence identity) to an amino acid sequence shown in any one of FIGS. 1-5.

Examples of polypeptides are shown in the Sequence Listing that have HMM bit scores greater than 130 when fitted to an HMM generated from the amino acid sequences set forth in FIG. 1 are identified in the Sequence Listing of this application. Such polypeptides include Ceres CLONE ID no.1915941 (SEQ ID NO:8), Ceres ANNOT ID no.1461830 (SEQ ID NO:10), Ceres CLONE ID no.1080942 (SEQ ID NO:15), and Ceres CLONE ID no.1073190 (SEQ ID NO:17).

Examples of polypeptides are shown in the Sequence Listing that have HMM bit scores greater than 185 when fitted to an HMM generated from the amino acid sequences set forth in FIG. 2 are identified in the Sequence Listing of this application. Such polypeptides include Ceres CLONE ID no.1842825 (SEQ ID NO:22), Ceres ANNOT ID no.1482536 (SEQ ID NO:28), Ceres CLONE ID no.463157 (SEQ ID NO:32), Ceres CLONE ID no.1674443 (SEQ ID NO:40), GI ID no.116310719 (SEQ ID NO:44), Ceres CLONE ID no.907473 (SEQ ID NO:58), and Ceres CLONE ID no.1755065 (SEQ ID NO:71).

Examples of polypeptides are shown in the Sequence Listing that have HMM bit scores greater than 655 when fitted to an HMM generated from the amino acid sequences set forth in FIG. 3 are identified in the Sequence Listing of this application. Such polypeptides include Ceres CLONE ID no.473040 (SEQ ID NO:79), Ceres CLONE ID no.922223 (SEQ ID NO:81), GI ID no.125528967 (SEQ ID NO:82), GI ID no.125573200 (SEQ ID NO:83), Ceres ANNOT ID no.1527409 (SEQ ID NO:85), GI ID no.92871098 (SEQ ID NO:86), Ceres CLONE ID no.1831117 (SEQ ID NO:88), and Ceres ANNOT ID no.857222 (SEQ ID NO:90).

Examples of polypeptides are shown in the Sequence Listing that have HMM bit scores greater than 315 when fitted to an HMM generated from the amino acid sequences set forth in FIG. 4 are identified in the Sequence Listing of this application. Such polypeptides include Ceres SEEDLINE ID no.ME17294 (SEQ ID NO:93), Ceres CLONE ID no.1831117 (SEQ ID NO:95), Ceres CLONE ID no.1844076 (SEQ ID NO:98), Ceres CLONE ID no.473040 (SEQ ID NO:104), Ceres CLONE ID no.922223 (SEQ ID NO:106), and GI ID no.125528967 (SEQ ID NO:107).

Examples of polypeptides are shown in the Sequence Listing that have HMM bit scores greater than 790 when fitted to an HMM generated from the amino acid sequences set forth in FIG. 5 are identified in the Sequence Listing of this application. Such polypeptides include LOCUS ID no. AT5G62000 (SEQ ID NO:112), Ceres ANNOT ID no.1527370 (SEQ ID NO:114), Ceres ANNOT ID no.1473961 (SEQ ID NO:116), GI ID no.62319853 (SEQ ID NO:117), GI ID no.62319903 (SEQ ID NO:118), GI ID no.47716275 (SEQ ID NO:119), GI ID no.125534572 (SEQ ID NO:120), GI ID no.26251300 (SEQ ID NO:121), GI ID no.115441981 (SEQ ID NO:123), GI ID no.23893346 (SEQ ID NO:124), GI ID no.115485689 (SEQ ID NO:125), GI ID no.108864435 (SEQ ID NO:126), GI ID no.50511471 (SEQ ID NO:127), LOCUS ID no. At2g33860 (SEQ ID NO:128), GI ID no.2245390 (SEQ ID NO:131), GI ID no.3228517 (SEQ ID NO:132), Ceres CLONE ID no.827306 (SEQ ID NO:134), Ceres CLONE ID no.1598488 (SEQ ID NO:136), GI ID no.125553314 (SEQ ID NO:138), and Ceres CLONE ID no.462443 (SEQ ID NO:143).

D. Percent Identity

In some embodiments, a cold tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 2, 20, 93, and 74.

Polypeptides having such a percent sequence identity often have a domain indicative of a cold tolerance-modulating polypeptide and/or have an HMM bit score that is greater than 130, as discussed above. Amino acid sequences of cold tolerance-modulating polypeptides having at least 80% sequence identity to one of the amino acid sequences set forth in SEQ ID NOs: 2, 20, 93, and 74 are provided in FIGS. 1-4 and in the Sequence Listing.

"Percent sequence identity" refers to the degree of sequence identity between any given reference sequence, e.g., SEQ ID NO:2, and a candidate cold tolerance-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chema et al., Nucleic Acids Res., 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a cold tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:2. Amino acid sequences of polypeptides having greater than 45% sequence identity to the polypeptide set forth in SEQ ID NO:2 are provided in FIG. 1 and in the Sequence Listing. Examples of such polypeptides include Ceres CLONE ID no.1915941 (SEQ ID NO:8), Ceres ANNOT ID no.1461830 (SEQ ID NO:10), Ceres CLONE ID no.1080942 (SEQ ID NO:15), and Ceres CLONE ID no.1073190 (SEQ ID NO:17).

In some cases, a cold tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:20. Amino acid sequences of polypeptides having greater than 45% sequence identity to the polypeptide set forth in SEQ ID NO:20 are provided in FIG. 2 and in the Sequence Listing. Examples of such polypeptides include Ceres CLONE ID no.1842825 (SEQ ID NO:22), Ceres ANNOT ID no.1482536 (SEQ ID NO:28), Ceres CLONE ID no.463157 (SEQ ID NO:32), Ceres CLONE ID no.1674443 (SEQ ID NO:40), GI ID no.116310719 (SEQ ID NO:44), Ceres CLONE ID no.907473 (SEQ ID NO:58), and Ceres CLONE ID no.1755065 (SEQ ID NO:71).

In some cases, a cold tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:93. Amino acid sequences of polypeptides having greater than 45% sequence identity to the polypeptide set forth in SEQ ID NO:93 are provided in FIG. 3 and in the Sequence Listing. Examples of such polypeptides include Ceres CLONE ID no.473040 (SEQ ID NO:79), Ceres CLONE ID no.922223 (SEQ ID NO:81), GI ID no.125528967 (SEQ ID NO:82), GI ID no.125573200 (SEQ ID NO:83), Ceres ANNOT ID no.1527409 (SEQ ID NO:85), GI ID no.92871098 (SEQ ID NO:86), Ceres CLONE ID no.1831117 (SEQ ID NO:88), and Ceres ANNOT ID no.857222 (SEQ ID NO:90).

In some cases, a cold tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:93. Amino acid sequences of polypeptides having greater than 45% sequence identity to the polypeptide set forth in SEQ ID NO:93 are provided in FIG. 4 and in the Sequence Listing. Examples of such polypeptides include Ceres CLONE ID no.1831117 (SEQ ID NO:95), Ceres CLONE ID no.1844076 (SEQ ID NO:98), Ceres CLONE ID no.473040 (SEQ ID NO:104), Ceres CLONE ID no.922223 (SEQ ID NO:106), and GI ID no.125528967 (SEQ ID NO:107).

In some cases, a cold tolerance-modulating tasiRNA acts upon an ARF amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:116. Amino acid sequences of polypeptides having greater than 45% sequence identity to the polypeptide set forth in SEQ ID NO:116 are provided in FIG. 5 and in the Sequence Listing. Examples of such polypeptides include LOCUS ID no. AT5G62000 (SEQ ID NO:112), Ceres ANNOT ID no.1527370 (SEQ ID NO:114), GI ID no.62319853 (SEQ ID NO:117), GI ID no.62319903 (SEQ ID NO:118), GI ID no.47716275 (SEQ ID NO:119), GI ID no.125534572 (SEQ ID NO:120), GI ID no.26251300 (SEQ ID NO:121), GI ID no.115441981 (SEQ ID NO:123), GI ID no.23893346 (SEQ ID NO:124), GI ID no.115485689 (SEQ ID NO:125), GI ID no.108864435 (SEQ ID NO:126), GI ID no.50511471 (SEQ ID NO:127), LOCUS ID no. At2g33860 (SEQ ID NO:128), GI ID no.2245390 (SEQ ID NO:131), GI ID no.3228517 (SEQ ID NO:132), Ceres CLONE ID no.827306 (SEQ ID NO:134), Ceres CLONE ID no.1598488 (SEQ ID NO:136), GI ID no.125553314 (SEQ ID NO:138), and Ceres CLONE ID no.462443 (SEQ ID NO:143).

E. Other Sequences

It should be appreciated that a cold tolerance-modulating polypeptide can include additional amino acids that are not involved in cold tolerance modulation, and thus such a polypeptide can be longer than would otherwise be the case. For example, a cold tolerance-modulating polypeptide can include a purification tag, a chloroplast transit peptide, a mitochondrial transit peptide, an amyloplast transit peptide, or a leader sequence added to the amino or carboxy terminus. In some embodiments, a cold tolerance-modulating polypeptide includes an amino acid sequence that functions as a reporter, e.g., a green fluorescent protein or yellow fluorescent protein.

III. Nucleic Acids

Nucleic acids described herein include nucleic acids that are effective to modulate cold tolerance levels when transcribed in a plant or plant cell. Such nucleic acids include, without limitation, those that encode a cold tolerance-modulating polypeptide and those that can be used to inhibit expression of a cold tolerance-modulating polypeptide via a nucleic acid based method.

A. Cold Tolerance-Modulating Nucleic Acids

Nucleic acids encoding cold tolerance-modulating polypeptides are described herein. Examples of such nucleic acids include SEQ ID NOs: 3, 5, 7, 9, 11, 14, 16, 18, 19, 21, 23, 25, 27, 31, 33, 35, 37, 39, 41, 55, 57, 70, 75, 78, 80, 84, 87, 89, 91, 92, 94, 97, 99, 103, 105, 109, 113, 115, 129, 133, 135, 140, and 142, as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 3, 5, 7, 9, 11, 14, 16, 18, 19, 21, 23, 25, 27, 31, 33, 35, 37, 39, 41, 55, 57, 70, 75, 78, 80, 84, 87, 89, 91, 92, 94, 97, 99, 103, 105, 109, 113, 115, 129, 133, 135, 140, and 142.

A cold tolerance-modulating nucleic acid can comprise the nucleotide sequence set forth in SEQ ID NO:1. Alternatively, a cold tolerance-modulating nucleic acid can be a variant of the nucleic acid having the nucleotide sequence set forth in SEQ ID NO:1. For example, a cold tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1.

A cold tolerance-modulating nucleic acid can comprise the nucleotide sequence set forth in SEQ ID NO:19. Alternatively, a cold tolerance-modulating nucleic acid can be a variant of the nucleic acid having the nucleotide sequence set forth in SEQ ID NO:19. For example, a cold tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:19.

A cold tolerance-modulating nucleic acid can comprise the nucleotide sequence set forth in SEQ ID NO:92. Alternatively, a cold tolerance-modulating nucleic acid can be a variant of the nucleic acid having the nucleotide sequence set forth in SEQ ID NO:92. For example, a cold tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:92.

A cold tolerance-modulating nucleic acid can comprise the nucleotide sequence set forth in SEQ ID NO:97. Alternatively, a cold tolerance-modulating nucleic acid can be a variant of the nucleic acid having the nucleotide sequence set forth in SEQ ID NO:97. For example, a cold tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:97.

A cold tolerance-modulating nucleic acid can comprise the nucleotide sequence set forth in SEQ ID NO:111. Alternatively, a cold tolerance-modulating nucleic acid can be a variant of the nucleic acid having the nucleotide sequence set forth in SEQ ID NO:111. For example, a cold tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:111.

A cold tolerance-modulating sequence can be at least a fragment of a nucleotide sequence such as Ceres ANNOT ID no.1473961 (SEQ ID NO:116) or homologs thereof. For example, the cold tolerance-modulating nucleotide may be a tasiRNA. Such cold tolerance-modulating nucleotide sequences can act upon a protein that comprises an auxin response factor motif. This motif is present in SEQ ID NO:112, which sets forth the amino acid sequence of an *Arabidopsis* clone, identified herein as LOCUS ID no. AT5G62000 (SEQ ID NO:112), that is predicted to encode an polypeptide comprising an auxin response factor motif. In certain embodiments, the protein comprising an auxin response factor motif is an ARF protein. The ARFs are key regulators of auxin-modulated gene expression. There are multiple ARF proteins, some of which activate, while others repress transcription. ARF proteins bind to auxin-responsive cis-acting promoter elements (AuxREs) using an N-terminal DNA-binding domain. It is thought that Aux/IAA proteins activate transcription by modifying ARF activity through the C-terminal protein-protein interaction domains found in both Aux/IAA and ARF proteins.

A cold tolerance-modulating sequence can be at least a fragment of a nucleotide sequence such as Ceres ANNOT ID no.1473961 (SEQ ID NO:116) or homologs thereof. For example, the cold tolerance-modulating nucleotide may be a tasiRNA. Such cold tolerance-modulating nucleotide sequences can act upon a protein that comprises a B3 DNA binding domain. This domain is present in SEQ ID NO:112, which sets forth the amino acid sequence of an *Arabidopsis* clone, identified herein as LOCUS ID no. AT5G62000 (SEQ ID NO:112), that is predicted to encode an polypeptide comprising an B3 DNA binding domain. In certain embodiments, the protein comprising a B3 DNA binding domain is an ARF protein.

In some embodiments, a cold tolerance-modulating sequence is a tasiRNA sequence or a homolog thereof, such tasiRNA sequence being encoded by a nucleic acid sequence that comprises a domain having 80% or greater sequence identity to nucleic acid residues 305 to about 346 of SEQ ID NO:111, residues 21 to about 62 of SEQ ID NO:66, residues 20 to about 61 of SEQ ID NO:67, residues 21 to about 62 of SEQ ID NO:72, residues 21 to about 62 of SEQ ID NO:73, residues 77 to about 118 of SEQ ID NO:144, residues 292 to about 313 of SEQ ID NO:145, residues 37 to about 78 of SEQ ID NO:146, residues 56 to about 97 of SEQ ID NO:147, residues 37 to about 78 of SEQ ID NO:148, residues 45 to about 86 of SEQ ID NO:149, residues 46 to about 98 of SEQ ID NO:150, residues 476 to about 497 of SEQ ID NO:151, residues 21 to about 62 of SEQ ID NO:152, residues 21 to about 62 of SEQ ID NO:153, residues 21 to about 62 of SEQ ID NO:154, residues 21 to about 62 of SEQ ID NO:155, or residues 21 to about 62 of SEQ ID NO:156.

In some embodiments, a cold tolerance-modulating sequence is a nucleotide sequence or a homolog thereof, such as a tasiRNA sequence, wherein said nucleotide is encoded by a nucleic acid sequence that also comprises an miR390 recognition sequence having 80% or greater sequence identity to nucleic acid residues 109 to about 129 of SEQ ID NO:66, residues 114 to about 135 of SEQ ID NO:67, residues 119 to about 139 of SEQ ID NO:72, residues 108 to about 128 of SEQ ID NO:73, residues 234 to about 254 of SEQ ID NO:144, residues 135 to about 176 of SEQ ID NO:145, residues 173 to about 189 of SEQ ID NO:147, residues 154 to about 170 of SEQ ID NO:148, residues 134 to about 157 of SEQ ID NO:149, residues 154 to about 198 of SEQ ID NO:150, residues 319 to about 360 of SEQ ID NO:151, residues 121 to about 141 of SEQ ID NO:152, residues 120 to about 140 of SEQ ID NO:153, residues 121 to about 141 of SEQ ID NO:154, residues 121 to about 141 of SEQ ID NO:155, residues 121 to about 141 of SEQ ID NO:156, or residues 462 to about 483 of SEQ ID NO:111. miR390 recognition sequences may guide in-phase processing of transcription (Allen et al. 2005).

In embodiments of the invention, a cold tolerance-modulating nucleotide, such as Ceres ANNOT ID no.1473961 (SEQ ID NO:116) or a homolog thereof, can act upon an polypeptide that comprises a B3 DNA binding domain having 80% or greater sequence identity to amino acid residues 163 to 268 of SEQ ID NO:112, residues 157 to 262 of SEQ ID NO:114, residues 157 to 262 of SEQ ID NO:116, residues 163 to 268 of SEQ ID NO:117, residues 163 to 268 of SEQ ID NO:118, residues 158 to 263 of SEQ ID NO:119, residues 148 to 253 of SEQ ID NO:120, residues 147 to 252 of SEQ ID NO:121, residues 123 to 228 of SEQ ID NO:122, residues 128 to 233 of SEQ ID NO:123, residues 131 to 236 of SEQ ID NO:124, residues 147 to 252 of SEQ ID NO:125, residues 148 to 253 of SEQ ID NO:126, residues 141 to 246 of SEQ ID NO:127, residues 158 to 263 of SEQ ID NO:128, residues 142 to 247 of SEQ ID NO:130, residues 158 to 263 of SEQ ID NO:131, residues 158 to 263 of SEQ ID NO:132, residues 126 to 231 of SEQ ID NO:134, residues 129 to 234 of SEQ ID NO:136, residues 114 to 219 of SEQ ID NO:137, residues 141 to 246 of SEQ ID NO:138, residues 176 to 281 of SEQ ID NO:139, residues 152 to 257 of SEQ ID NO:141, or residues 121 to 225 of SEQ ID NO:143.

In embodiments of the invention, a cold tolerance-modulating tasiRNA sequence such as Ceres ANNOT ID no.1473961 (SEQ ID NO:116) can act upon an ARF polypeptide that comprises an auxin response factor motif having 80% or greater sequence identity to amino acid residues 290 to 372 of SEQ ID NO:112, residues 284 to 366 of SEQ ID NO:114, residues 284 to 366 of SEQ ID NO:116, residues 290 to 372 of SEQ ID NO:117, residues 290 to 372 of SEQ ID NO:118, residues 285 to 367 of SEQ ID NO:119, residues 275 to 357 of SEQ ID NO:120, residues 274 to 356 of SEQ ID NO:121, residues 250 to 331 of SEQ ID NO:122, residues 255 to 336 of SEQ ID NO:123, residues 258 to 340 of SEQ ID NO:124, residues 274 to 356 of SEQ ID NO:125, residues 275 to 357 of SEQ ID NO:126, residues 268 to 349 of SEQ ID NO:127, residues 285 to 367 of SEQ ID NO:128, residues 269 to 351 of SEQ ID NO:130, residues 285 to 367 of SEQ ID NO:131, residues 285 to 367 of SEQ ID NO:132, residues 253 to 334 of SEQ ID NO:134, residues 256 to 337 of SEQ ID NO:136, residues 241 to 322 of SEQ ID NO:137, residues 268 to 349 of SEQ ID NO:138, residues 302 to 384 of SEQ ID NO:139, residues 279 to 361 of SEQ ID NO:141, or residues 247 to 332 of SEQ ID NO:143.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in PCR Primer: A Laboratory Manual, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of a Cold Tolerance-Modulating Polypeptide A nucleic acid encoding one of the cold tolerance-modulating polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular cold tolerance-modulating polypeptide; i.e., for many amino acids, there is more than one nucleotide triplet that serves as the codon for the amino acid. Thus, codons in the coding sequence for a given cold tolerance-modulating polypeptide can be modified such that optimal expression in a particular plant species is obtained, using appropriate codon bias tables for that species.

In some cases, expression of a cold tolerance-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of a Cold Tolerance-Modulating Polypeptide

Polynucleotides and recombinant constructs described herein can be used to inhibit expression of a cold tolerance-modulating polypeptide in a plant species of interest. See, e.g., Matzke and Birchler, *Nature Reviews Genetics* 6:24-35 (2005); Akashi et al., *Nature Reviews Mol. Cell. Biology* 6:413-422 (2005); Mittal, *Nature Reviews Genetics* 5:355-365 (2004); Dorsett and Tuschl, *Nature Reviews Drug Discovery* 3: 318-329 (2004); and *Nature Reviews RNA interference collection*, October 2005 at nature.com/reviews/focus/mai. Typically, at least a fragment of a nucleic acid encoding cold tolerance-modulating polypeptides and/or its complement is expressed. A fragment is typically at least 20 nucleotides long, as needed for the methods noted below. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding cold tolerance-modulating polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid segment from a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid segment need not be the entire sequence of the gene to be repressed, but typically will be substantially complementary to at least a portion of the sense strand of the gene to be repressed. Generally, higher homology can be used to compensate for the use of a shorter sequence. Typically, a sequence of at least 30 nucleotides is used, e.g., at least 40, 50, 80, 100, 200, 500 nucleotides or more.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13):6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophile*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of a cold tolerance-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the cold tolerance-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding a cold tolerance-modulating polypeptide, and the other strand of the stem portion of the double stranded RNA comprises a sequence that is similar or identical to the sequence that is complementary to the 3' or 5' untranslated region, respectively, or a fragment thereof, of the mRNA encoding the cold tolerance-modulating polypeptide. In other embodiments, one strand of the stem portion of a double stranded RNA comprises a sequence that is similar or identical to the sequence of an intron, or a fragment thereof, in the pre-mRNA encoding a cold tolerance-modulating polypeptide, and the other strand of the stem portion comprises a sequence that is similar or identical to the sequence that is complementary to the sequence of the intron, or a fragment thereof, in the pre-mRNA. The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron. A double stranded RNA can have zero, one, two, three, four, five, six, seven, eight, nine, ten, or more stem-loop structures. A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

microRNA (miRNA) and tasiRNA, which are non-protein coding RNAs, can also be used to inhibit the expression of a gene. The gene targeted for inhibition may be an endogenous plant gene, a viral gene, a bacterial gene, a fungal gene, or an insect gene. miRNAs and tasiRNAs are regulatory agents consisting of about 19 to 25 ribonucleotides. miRNA are highly efficient at inhibiting the expression of endogenous genes and/or can guide in-phase processing of tasiRNA primary transcripts. tasiRNAs similarly inhibit gene expression by interacting with target mRNAs and guide cleavage by the same mechanism as do plant miRNAs, but differ from miRNAs in that they arise from double-stranded RNA, which may require RNA-dependent RNA polymerases.

For example, a tasiRNA can act upon an auxin responsive protein (ARF) (e.g., ARF3 or ARF4). In particular, inhibition of the expression of an ARF encoding gene (e.g., ARF3 or ARF4) may be obtained by interference by expression of a nucleic acid sequence encoding a tasiRNA. Transcription of a tasiRNA encoding nucleic acid sequence can be under the control of a promoter, such as, but not limited to, those promoters and regulatory regions described herein, or under promotional control of a tasiRNA coding sequence's own promoter. For such interference, the expression cassette is designed to express an RNA molecule that is modeled on an endogenous tasiRNA encoding sequence. The tasiRNA encoding sequence encodes an RNA that forms a hairpin structure containing a nucleotide sequence that is complementary to another endogenous gene (target sequence). For suppression of ARF protein expression, the nucleotide sequence is selected from an ARF transcript sequence and contains about 19 to 25 nucleotides of said ARF protein sequence in sense orientation and about 19 to 25 nucleotides of a corresponding antisense sequence that is complementary to the sense sequence. tasiRNA molecules are highly efficient at inhibiting the expression of endogenous genes. In *Arabidopsis*, a nuclear DCL enzyme is believed to be required for mature miRNA formation (Xie et al. (2004) PLoS Biol., 2:642-652, which is incorporated by reference herein) Inhibition of gene expression by miRNAs and tasiRNAs and methods for inhibition are known to those of skill in the art. See, for example, Javier, et al., (2003) Nature 425:257-263; Bartel (2004) Cell, 116:281-297; Kim (2005) Nature Rev. Mol. Cell. Biol., 6:376-385; and Allen et al. (2005) Cell, 121:207-221, all of which are incorporated by reference herein.

Constructs containing regulatory regions operably linked to nucleic acid molecules in sense orientation can also be used to inhibit the expression of a gene. The transcription product can be similar or identical to the sense coding sequence, or a fragment thereof, of a cold tolerance-modulating polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a cold tolerance-modulating polypeptide, or a fragment of such sequences. In some embodiments, the sense or antisense sequence is identical or complementary to a sequence of the regulatory region that drives transcription of the gene encoding a cold tolerance-modulating polypeptide. In each case, the sense sequence is the sequence that is complementary to the antisense sequence.

The sense and antisense sequences can be any length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding a cold tolerance-modulating polypeptide described herein. The sense sequence complementary to the antisense sequence can be a sequence present within the mRNA of the cold tolerance-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have any arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences, or the left and right border-like sequences of the P-DNA, flank or are on either side of the nucleic acid. See, US 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.*, 7:187-195; Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate cold tolerance levels. A recombinant nucleic acid construct can comprise a nucleic acid encoding a cold tolerance-modulating polypeptide as described herein, operably linked to a regulatory region suitable for expressing the cold tolerance-modulating polypeptide in the plant or cell. Thus, a nucleic acid can comprise a coding sequence that encodes any of the cold tolerance-modulating polypeptides as set forth in SEQ ID NOs: 2, 20, 93, 74, or a homologs thereof. Examples of nucleic acids encoding cold tolerance-modulating polypeptides are set forth in SEQ ID NOs: 1, 19, 92, 97, or 111, and in FIGS. 1-4 and in the Sequence Listing. The cold tolerance-modulating polypeptide encoded by a recombinant nucleic acid can be a native cold tolerance-modulating polypeptide, or can be heterologous to the cell. In some cases, the recombinant construct contains a nucleic acid that inhibits expression of a cold tolerance-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; and PCT/US07/62762.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

ii Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

iii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

iv. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell. Biol.*, 13:5829-5842 (1993)), the beta-amylase promoter, and the barley hordein promoter. Other maturing endosperm promoters include the YP0092, PT0676, and PT0708 promoters.

v. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

vi. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.*, 32:571-57; Conceicao (1994) *Plant*, 5:493-

505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142: 1009-1020); maize Cat3 (see, GenBank No. L05934; Abler (1993) *Plant Mol. Biol.*, 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOs-FIE2-2, pOsMEA, pOsYp102, and pOsYp285.

vii. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097, YP0107, YP0088, YP0143, YP0156, PT0650, PT0695, PT0723, PT0838, PT0879, and PT0740.

viii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

ix. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3 (10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2): 687-692 (2004)).

x. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) Nature Biotech 17: 287-291).

xi. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a cold tolerance-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. Transgenic Plants and Plant Cells

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided, as long as the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous cold tolerance-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of a cold tolerance-modulating polypeptide or nucleic acid. Physical and biochemical methods can be used to identify expression levels. These include Southern analysis or PCR amplification for detection of a polynucleotide; Northern blots, S1 RNAse protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of cold tolerance. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a cold tolerance level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (eucalyptus), *Triticosecale* (Triticum—wheat×rye) and bamboo.

Suitable species also include *Helianthus annuus* (sunflower), *Carthamus tinctorius* (safflower), *Jatropha curcas*

(*jatropha*), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassava).

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii*, and *Tanacetum parthenium*.

Suitable species also include *Parthenium argentatum* (guayule), *Hevea* spp. (rubber), *Mentha spicata* (mint), *Mentha piperita* (mint), *Bixa orellana*, and *Alstroemeria* spp.

Suitable species also include *Rosa* spp. (rose), *Dianthus caryophyllus* (carnation), *Petunia* spp. (*petunia*) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple, *Hordeum vulgare* (barley), *Poa pratensis* (bluegrass), *Lolium* spp. (ryegrass) and *Phleum pratense* (timothy).

Thus, the methods and compositions can be used over a broad range of plant species, including species from the dicot genera *Brassica, Carthamus, Glycine, Gossypium, Helianthus, Jatropha, Parthenium, Populus*, and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum*, and *Zea*. In some embodiments, a plant is a member of the species *Panicum virgatum* (switchgrass), *Sorghum bicolor* (sorghum, sudangrass), *Miscanthus giganteus* (*miscanthus*), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., *Saccharum* sp.×*Miscanthus* sp.).

D. Transgenic Plant Phenotypes

In some embodiments, a plant in which expression of a cold tolerance-modulating polypeptide is modulated can have increased levels of cold tolerance and/or biomass in vegetative tissues. Cold tolerance can be measured by means well know to those of skill in the art, including, but not limited to, seedling survival, decreased photosynthesis and membrane damage (measured by electrolyte leakage), seedling area, yield, and or biomass. For example, a cold tolerance-modulating polypeptide or nucleic acid described herein can be expressed in a transgenic plant, resulting in increased levels of cold tolerance and/or biomass. The cold tolerance level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, 70, 80, 90, 100 or more than 100 percent, as compared to the cold tolerance level in a corresponding control plant that does not express the transgene. In some embodiments, a plant in which expression of a cold tolerance-modulating polypeptide or polynucleotide is modulated can have increased levels of biomass. The biomass level can be increased by at least 2 percent, e.g., 2, 3, 4, 5, 10, 15, 20, 25, 30, 35, 40, 50, 60, 70, 80, 90, 100, or more than 100 percent, as compared to the biomass level in a corresponding control plant that does not express the transgene. In some embodiments, differences can be measured for a plant in which expression of a cold tolerance-modulating polypeptide is modulated can be exposed to cold for one or more periods of time that may vary depending on climatic conditions. For example, for periods of about ½ hour, 1 hour, 3 hours, 6 hours, 12 hours, 1 day, 3 days, 5 days, 10 days, 1 month, 3 months, 6 months, 12 months, or the entire lifespan of such a plant.

Increases in cold tolerance in such plants can provide improved nutritional quantity and content in geographic locales where cold affects plants. Increases in cold tolerance in such plants can be useful in situations where plant parts such as, but not limited to, seeds, tubers, stems, leaves or roots are harvested for human or animal consumption.

Decrease in cold tolerance in such plants can be useful for species or varieties of plants that benefit from cold exposure. For example, cold sensitive plants might be able to undergo vernalization more easily. Decreases in cold tolerance in such plants can be useful in situations where plant parts such as, but not limited to, seeds, tubers, stems, leaves or roots are harvested for human or animal consumption.

Typically, a difference in the level of cold tolerance in a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the level of cold tolerance is statistically significant at $p<0.01$, $p<0.005$, or $p<0.001$. A statistically significant difference in, for example, the level of cold tolerance in a transgenic plant compared to the amount in cells of a control plant indicates that the recombinant nucleic acid present in the transgenic plant results in altered cold tolerance levels.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNAse protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

V. Plant Breeding

Genetic polymorphisms are discrete allelic sequence differences in a population. Typically, an allele that is present at 1% or greater is considered to be a genetic polymorphism. The discovery that polypeptides disclosed herein can modulate cold tolerance content is useful in plant breeding, because genetic polymorphisms exhibiting a degree of linkage with loci for such polypeptides are more likely to be correlated with variation in a cold tolerance trait. For example, genetic polymorphisms linked to the loci for such polypeptides are more likely to be useful in marker-assisted breeding programs to create lines having a desired modulation in the cold tolerance trait.

Thus, one aspect of the invention includes methods of identifying whether one or more genetic polymorphisms are associated with variation in a cold tolerance trait. Such methods involve determining whether genetic polymorphisms in a given population exhibit linkage with the locus for one of the polypeptides depicted in FIGS. 1 to 4 and/or functional homologs thereof, such as, but not limited to those identified in the Sequence Listing of this application. The correlation is measured between variation in the cold tolerance trait in plants of the population and the presence of the genetic polymorphism(s) in plants of the population, thereby identifying whether or not the genetic polymorphism(s) are associated with variation for the trait. If the presence of a particular allele is statistically significantly correlated with a desired modulation in the cold tolerance trait, the allele is associated with variation for the trait and is useful as a marker for the trait. If, on the other hand, the presence of a particular allele is not significantly correlated with the desired modulation, the allele is not associated with variation for the trait and is not useful as a marker.

Such methods are applicable to populations containing the naturally occurring endogenous polypeptide rather than an exogenous nucleic acid encoding the polypeptide, i.e., populations that are not transgenic for the exogenous nucleic acid. It will be appreciated, however, that populations suitable for use in the methods may contain a transgene for another, different trait, e.g., herbicide resistance.

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. If the probes flank an SSR in the population, PCR products of different sizes will be produced. See, e.g., U.S. Pat. No. 5,766,847. Alternatively, SSR polymorphisms can be identified by using PCR product(s) as a probe against Southern blots from different individuals in the population. See, U. H. Refseth et al., (1997) Electrophoresis 18: 1519. The identification of RFLPs is discussed, for example, in Alonso-Blanco et al. (Methods in Molecular Biology, vol. 82, *"Arabidopsis* Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), The Maize Handbook, c. 1994 by Springer-Verlag New York, Inc.: New York, N.Y., USA; Berlin Germany; Burr et al. Genetics (1998) 118: 519; and Gardiner, J. et al., (1993) Genetics 134: 917). The identification of AFLPs is discussed, for example, in EP 0 534 858 and U.S. Pat. No. 5,878,215.

In some embodiments, the methods are directed to breeding a plant line. Such methods use genetic polymorphisms identified as described above in a marker assisted breeding program to facilitate the development of lines that have a desired alteration in the cold tolerance trait. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VI. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought. In some embodiments, plants described herein have a composition that permits more efficient processing into free sugars, and subsequently ethanol, for energy production. In some embodiments, such plants provide higher yields of ethanol, butanol, other biofuel molecules, and/or sugar-derived co-products per kilogram of plant material, relative to control plants. Such processing efficiencies are believed to be derived from the chemical composition of the plant material. By providing higher yields at an equivalent or even decreased cost of production relative to control plants that do not have increased levels of cold tolerance, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

VII. Examples

Example 1

Transgenic *Arabidopsis* Plants

The following symbols are used in the Examples with respect to *Arabidopsis* transformation: T1: first generation transformant; T2: second generation, progeny of self-pollinated T1 plants; T3: third generation, progeny of self-pollinated T2 plants; T4: fourth generation, progeny of self-pollinated T3 plants. Independent transformations are referred to as events.

The following is a list of nucleic acids that were isolated from *Arabidopsis thaliana* plants, Clone 2273, Clone 924103, and Clone 13209. The nucleic acids designated Clone 6639 and Clone 924103 were isolated from the species *Triticum aestivum*.

Each isolated nucleic acid described above was cloned into a Ti plasmid vector containing a phosphinothricin acetyltransferase gene which confers Finale™ resistance to transformed plants. A Ti plasmid vector useful for these constructs is CRS 338. Unless otherwise indicated, each Ceres Clone and/or Seedline derived from a Clone is in the sense orientation relative to either the 35S promoter in a Ti plasmid. Wild-type *Arabidopsis thaliana* ecotype Wassilewskija (Ws) plants were transformed separately with each construct. The transformations were performed essentially as described in Bechtold et al., C.R. Acad. Sci. Paris, 316:1194-1199 (1993).

Wild-type *Arabidopsis* Wassilewskija (Ws) plants were transformed with a Ti plasmid containing Clone 924103 in the sense orientation relative to the 326F promoter. The Ti plasmid vector used for this construct, CRS814, contains the Ceres-constructed, plant selectable marker gene phosphinothricin acetyltransferase (PAT) which confers herbicide resistance to transformed plants.

Wild-type *Arabidopsis* Wassilewskija (Ws) plants were transformed with a Ti plasmid containing clone 2273 in the sense orientation relative to the 32449 promoter.

Wild-type *Arabidopsis* Wassilewskija (Ws) plants were transformed with a Ti plasmid containing clone 13209 in the sense orientation relative to the 32449 promoter. The Ti plasmid vector used for this construct, CRS311, contains the Ceres-constructed, plant selectable marker gene phosphinothricin acetyltransferase (PAT) which confers herbicide resistance to transformed plants Transgenic *Arabidopsis* lines containing Clone 2273, Clone 6639, Clone 924103, or Clone 13209 were designated ME00327, ME04315, ME17294, or ME00572 respectively. The presence of each vector containing a nucleic acid described above in the respective transgenic *Arabidopsis* line transformed with the vector was confirmed by Finale™ resistance, PCR amplification from green leaf tissue extract, and/or sequencing of PCR products. As controls, wild-type *Arabidopsis* ecotype Ws plants were transformed with the empty vector—SR0059.

Example 2

Screening for Cold Tolerance in Transgenic Plants

How plants respond to stress in the environment dictates their ability to survive and reproduce. There are probably many mechanisms by which plants regulate the temperatures under which they will germinate (Lu and Hills, 2003). A number of polynucleotides that result in stress tolerance when over-expressed have been identified in model species such as *Arabidopsis*.

Over-expression of these polynucleotides could be useful for increasing low temperature, chilling or cold tolerance in crops. Assays described here focus on low temperature, chilling or cold tolerance in seedlings. The ability to germinate and grow under low temperature, chilling or cold, and wet conditions would allow a longer growing season and mitigate damage caused by unexpected low temperature, chilling or cold periods. If this trait is recapitulated in crops overexpressing these polynucleotides, the result could be very valuable in agriculture in many crops and environments and make a significant contribution to sustainable farming. Furthermore, low temperature, chilling or cold tolerance may be modulated by expressing these polynucleotides under the control of a low temperature, chilling or cold inducible promoter.

1. Cold Growth Superpool Screen

Plates of solidified agar MS medium are prepared for the screen as follows. One liter of medium is prepared by mixing 2.15 g of MS basal salt mixture (from Phytotech M524) and 7 g of agar (from EM Science, 1.01614.1000) in water, and adjusting the pH to 5.7 with a 10N KOH solution. After autoclaving, 45 ml of media are transferred under sterile conditions per 100 mm square×15 mm deep plate.

Individual superpool and control seeds are sterilized in a 30% bleach solution for 5 minutes. Seeds are then rinsed repeatedly with sterile water to eliminate all bleach solution. Seeds are plated using a COPAS™ robot (Union Biometrica, Holliston, Mass.) at a density of 72 seeds per plate. The plates are wrapped with vent tape and transferred to a dark 4° C. refrigerator for 3 days to promote uniform germination. The plates are then placed horizontally in a Conviron growth chamber set at 22'C, 16:8 hour light:dark cycle, 70% humidity with fluorescent lamps emitting a light intensity of ~100 μEinsteins. Normal growth is allowed to occur for 3-5 days. At end of 3-5 days of growth, images of the plates are scanned using an Epson perfection 4870 scanner. Then, cold-growth treatment is applied for 1-3 weeks. Accordingly, plates are transferred in a horizontal position to an 8'C Conviron chamber under constant light at ~100 μEinsteins. After a defined number of days of cold-growth treatment, for example 7 or 14, the plates are scanned again. The WinRhizo software program (Regent Instruments Inc., Canada) is used to determine the area for each seedling from the scanned images.

Individual seedlings that perform better in the cold growth screen are identified by visual inspection for those showing obvious morphological differences and by statistical analysis of the seedling area data. DNA from these candidate seedlings is extracted and the transgene amplified using PCR. The PCR product is sequenced to determine the identity of the transgene and consequently the ME line from which the candidate is derived.

2. Cold Growth Assay

The cold growth assay is used to validate candidate misexpression (ME) lines obtained from screens for enhanced growth under cold conditions. This procedure allows a high-throughput methodology for assessing transgenic Arabidopsis candidates that have germinated at normal temperature (22° C.) and light (~100 to 200 µEinsteins) in a walk-in growth chamber on agar solidified MS medium before transfer to cold temperature. It relies on the ability to discriminate between seedlings that have become significantly larger during cold growth than controls by imaging the seedlings when they are transferred to the cold and then periodically thereafter under cold growth conditions.

Plate preparation for the cold growth assay and the growth conditions are the same as those described for the cold growth screen as described above. Seeds from independent transformation events for each ME line are bleach sterilized and then plated at a density of 40 seeds per plate (30 seeds from the event and 10 wild-type control seeds). After cold-growth treatment, the seedlings are then FINALE®-treated to identify the plants carrying the ME vector.

Cold growth is characterized by statistical analysis as follows. The control population is the internal non-transgenic segregants for that particular event. When there are not enough internal non-transgenic segregants for an event, a pool of all non-transgenic segregants from all events associated with that ME line is used (i.e. when non-transgenics are less than five for the event or the event appears to be homozygous). Pooling is only done for events associated with the same ME line and within an experiment (an experiment is the set of plates with a common sow date). Thus in the final analysis, the pooled control population may be different for generations $T_2$ and $T_3$.

The WinRhizo software program (Regent Instruments Inc., Canada) is used to determine the area for each seedling. The change in area is calculated for a defined number of days of treatment. A one-tailed t-test is used to compare change in area and the mean size of the transgenic seedlings within an event to the internal non-transgenic segregants. Significance is assessed at an α-value of 0.05.

3. Cold Flux Assay

The cold flux growth assay is used to validate candidate misexpression (ME) lines obtained from screens for enhanced growth under fluctuating cold conditions. This procedure allows a high-throughput methodology for assessing transgenic Arabidopsis candidates that have germinated at normal temperature (22° C.) and light (~100 to 200 µEinsteins) in a walk-in growth chamber on agar solidified MS medium before transfer to cold temperature. It relies on the ability to discriminate between seedlings that have become significantly larger during growth under fluctuating cold conditions than controls by imaging the seedlings when they are transferred to the cold and then periodically thereafter under cold growth conditions.

Plate preparation for the cold growth assay and the growth conditions are the same as those described for the cold growth screen as described above. Seeds from independent transformation events for each ME line are bleach sterilized and then plated at a density of 61 seeds per plate (including both seeds from the event and wild-type control seeds). After cold flux-growth treatment, the seedlings are then FINALE®-treated to identify the plants carrying the ME vector.

Normal growth is allowed to occur for 3-5 days. At end of 3-5 days of growth, images of the plates are scanned using an Epson perfection 4870 scanner. After 3-5 days growth in normal conditions, the plates are transferred in a horizontal position to an 8° C. Conviron under constant light at ~100 µEinsteins. All transfers take place in the morning. Growth is allowed at 8° C. for 3-4 days. After 3-4 days growth at 8° C., plates are transferred to 1° C. Percival under constant light at ~70 µEinsteins. Growth is allowed at 1° C. for 3-4 days. 8° C./1° C. cycling is repeated for a total of 14 days. The plates are imaged using CF imager and Winrhizo scanner. Individual seedlings are selected which are significantly larger and/or exhibit increased photosynthetic efficiency (Fv/Fm). Plates are visually observed as well. DNA from these candidate seedlings is extracted and the transgene amplified using PCR. The PCR product is sequenced to determine the identity of the transgene and consequently the ME line from which the candidate is derived. These seedlings are then grown for progeny seed.

Cold flux growth is characterized by statistical analysis as follows. The control population is the internal non-transgenic segregants for that particular event. When there are not enough internal non-transgenic segregants for an event, a pool of all non-transgenic segregants from all events associated with that ME line is used (i.e. when non-transgenics are less than five for the event or the event appears to be homozygous). Pooling is only done for events associated with the same ME line and within an experiment (an experiment is the set of plates with a common sow date). Thus in the final analysis, the pooled control population may be different for generations T2 and T3.

The WinRhizo software program (Regent Instruments Inc., Canada) is used to determine the area for each seedling. The change in area is calculated for a defined number of days of treatment. A one-tailed t-test is used to compare change in area and the mean size of the transgenic seedlings within an event to the internal non-transgenic segregants. Significance is assessed at an α-value of 0.05.

Example 3

Results for ME00327 Events (SEQ ID NO:2)

Ectopic expression of clone 2273 (from Arabidopsis thaliana) under the control of the 32449 promoter in the ME00327 plants results in larger seedlings after 14 days fluctuation between 8° C. and 1° C.

The seedling area of transgenic plants within a seed line was compared to that of non-transgenic segregants within the same seed line after 14 days of growth at fluctuating temperatures of 8° C. and 1° C. Six events of ME00327 were analyzed as described in the cold flux assay (Example 2). Events –04 and –06 were significant in at least two generations at p<0.05 using a one-tailed t-test assuming unequal variance (Table 1). The transgenic plants were visibly larger than the controls.

Event –04 segregated 3:1 (R:S) for Finale™ resistance in the $T_2$ generation. Event –06 appears to segregate for two inserts (15:1) in the $T_2$ generation.

TABLE 1 t-test comparison of seedling area between transgenic seedlings and control non-transgenic segregants after 14 days fluctuation between 8° C. and 1° C.

| Events | Event-Gen | Transgenic Avg | SE | N | Control Non-Transgenics[a] Avg | SE | N | t-test p-value |
|---|---|---|---|---|---|---|---|---|
| ME00327-04 | -04-T2 | 0.0383 | 0.0014 | 16 | 0.0297 | 0.0011 | 14 | 2.58E−05 |
| ME00327-04-02 | -04-T3 | 0.0490 | 0.0023 | 27 | 0.0410 | 0.0019 | 32 | 4.48E−03 |
| ME00327-04-03 | -04-T3 | 0.0522 | 0.0018 | 32 | 0.0378 | 0.0020 | 26 | 9.46E−07 |
| ME00327-04-04 | -04-T3 | 0.0497 | 0.0020 | 35 | 0.0364 | 0.0022 | 25 | 1.38E−05 |
| ME00327-06[c] | -06-T2 | 0.0314 | 0.0011 | 29 | 0.0272 | 0.0009 | 39 | 1.98E−03 |
| ME00327-06[bc] | -06-T2 | 0.0392 | 0.0012 | 54 | 0.0346 | 0.0008 | 194 | 8.17E−04 |
| ME00327-06-01 | -06-T3 | 0.0296 | 0.0015 | 41 | 0.0232 | 0.0016 | 17 | 2.47E−03 |
| ME00327-06-03 | -06-T3 | 0.0356 | 0.0015 | 42 | 0.0290 | 0.0019 | 15 | 4.44E−03 |

[a]Transgenic seedlings were compared to internal non-transgenic segregants within an event unless otherwise indicated.
[b]These events were sown twice. The first time was to identify ME00327 as a Hit. They were repeated the second time with the next generation to identify ME00327 as a Lead.
[c]These events did not segregate non-transgenic seedlings and were compared to pooled non-transgenics for the line.

Plants from Events −04 and −06 which are hemizygous or homozygous for clone 2273 do not show any negative phenotypes under standard conditions. Events −04 and −06 of ME00327 were tested for negative phenotypes compared to the empty vector control SR00559. The results showed no detectable reduction in germination rate, the plants appeared wild-type in all instances, and no statistical differences in days to flowering, rosette area 7 days post-bolting, or fertility (silique number and seed fill).

Example 4

Results for ME04315 Events (SEQ ID NO:20)

Candidate ME04315 was identified by superpool screen described above in Example 2. Ectopic expression of Clone 6639 under the control of the 35S promoter in ME04315 plants results in early germination at 8° C. resulting in larger seedlings after 10 days at 8° C.

The seedling area of transgenic plants within a seed line was compared to that of non-transgenic segregants within the same seed line after 10 days of growth at 8° C. Nine events of ME04315 were analyzed as described in the Cold Growth Assay described in Example 2 and showed significant tolerance under cold conditions in two generations. Three Events, −02, −03 and −06, were significant in both generations at $p<0.05$ using a one-tailed t-test assuming unequal variance (Table 2). '−99' signifies that seeds were pooled from several plants. Events −02 and −06 were from the T3 generation because T2 seed was not available. Subsequently, next generation seeds for three of the events (T3 or T4 as needed) were evaluated under cold germination conditions.

The transgenic plants were visibly larger and lighter in color than the controls. Under cold conditions, seedlings typically become darker, presumably due to the accumulation of anthocyanin. The lighter color exhibited by ME04315 seedlings suggests a decrease in this stress response. ME04315 plants grown under standard conditions in soil did not appear different in color than controls.

Event −03 segregated 3:1 (R:S) for Finale™ resistance in the $T_2$ generation. Seed collected from individual, hemizygous plants was not available for Events −02 and −06. However, the $T_3$ generation seeds that were pooled from several $T_2$ plants segregated approximately 2:1 in a manner consistent with a single insert for Event −06 (only transgenic plants were pooled). Pooled $T_3$ generation seeds for Event −02 segregated 1:3.

TABLE 2

T-test comparison of seedling area between transgenic seedlings and control non-transgenic segregants after 10 days at 8° C.

| Events | Event-Gen | Transgenic Avg | SE | N | Control Non-Transgenics[a] Avg | SE | N | t-test p-value |
|---|---|---|---|---|---|---|---|---|
| ME04315-02-99[b] | 02-T3 | 0.0071 | 0.0013 | 10 | 0.0049 | 0.0007 | 24 | 7.50E−02 |
| ME04315-02-99 | 02-T3 | 0.0046 | 0.0007 | 16 | 0.0036 | 0.0002 | 50 | 7.92E−02 |
| ME04315-02-99-02[a] | 02-T4 | 0.0070 | 0.0002 | 61 | 0.0047 | 0.0002 | 213 | 6.66E−16 |
| ME04315-02-99-03 | 02-T4 | 0.0072 | 0.0002 | 45 | 0.0057 | 0.0007 | 3 | 2.08E−02 |
| ME04315-03[b] | 03-T2 | 0.0026 | 0.0002 | 18 | 0.0017 | 0.0003 | 7 | 0.0070 |
| ME04315-03 | 03-T2 | 0.0017 | 0.0001 | 35 | 0.0016 | 0.0001 | 19 | 0.2221 |
| ME04315-03-02 | 03-T3 | 0.0078 | 0.0005 | 12 | 0.0045 | 0.0011 | 7 | 6.69E−03 |
| ME04315-03-03 | 03-T3 | 0.0063 | 0.0003 | 45 | 0.0053 | 0.0004 | 24 | 0.0153 |
| ME04315-06-99[b] | 06-T3 | 0.0034 | 0.0006 | 16 | 0.0023 | 0.0003 | 14 | 0.0499 |
| ME04315-06-99 | 06-T3 | 0.0029 | 0.0002 | 42 | 0.0021 | 0.0001 | 28 | 9.52E−04 |
| ME04315-06-99-02[a] | 06-T4 | 0.0072 | 0.0002 | 61 | 0.0047 | 0.0002 | 213 | 3.33E−16 |

[a]Transgenic seedlings were compared to non-transgenic segregants within a seed line except for the $T_4$ generation of Events -02 and -06. Since these seed lines were homozygous, they were compared to pooled non-transgenic segregants from another $T_4$ generation event that was grown in the same flat as the $T_4$ generation of Events -02 and -06.
[b]These events were sown twice. The first time was to identify ME04315 as a hit. They were repeated the second time with two generations to identify ME04315 as a Lead.

Plants from Events −02, −03 and −06 which are hemizygous or homozygous for Clone 6639 do not show any negative phenotypes under long-day conditions. The physical appearance of eight of the nine $T_1$ plants was identical to the controls. Event −06 was smaller and had fewer rosette leaves.

Events −02, −03 and −06 of ME04315 exhibited no statistically significant negative phenotypes compared to empty vector control SR00559. There was no detectable reduction in germination rate, the plants appeared wild-type in all instances, and there was no observable or statistical differences between experimentals and controls for days to flowering, rosette area 7 days post-bolting or fertility (silique number and seed fill).

Example 5

Results for ME17294 Events (SEQ ID NO:93) 5' Truncated

Nine events of ME17294 (Clone 924103 from *Triticum aestivum*) were analyzed as described in the cold germination assay (Example 2). In this study, the seedling area (a measure of germination timing and cotyledon expansion) of transgenic plants within a seed line was compared to that of non-transgenic segregants within the same seed line, except for the T3 generation of both events. These seed lines were homozygous for the transgene. For these seed lines, we used pooled non-transgenic segregants from another T3 generation event of ME17294 that were collected from plants grown in the same flat as the T3 generation of Events −08 and −09.

The two events, −08 and −09, were significant in two generations at p<0.05 using a one-tailed t-test assuming unequal variance (Table 3). The transgenic plants are visibly larger.

Events −08 and −09 segregated 3:1 (R:S) for Finale™ resistance in the $T_2$ generation. No $T_1$ phenotypes were reported for this line.

Plants from Events −08 and −09 which are hemizygous or homozygous for clone 924103 do not show any negative phenotypes under standard conditions. Events −08 and −09 of ME17294 exhibited no statistically significant negative phenotypes compared to empty vector control SR00559. There was no detectable reduction in germination rate, the plants appeared wild-type in all instances, and there were no statistical differences between experimentals and controls for days to flowering, rosette area 7 days post-bolting, or fertility (silique number and seed fill).

Example 6

Results for ME00572 Events (SEQ ID NO:111) tasiRNA

Clone 13209, in ME00572 plants, is a trans-acting small interfering RNA (tasiRNA) that interacts with ARFs (Auxin Response Factors). A megapool containing superpools 9-12 was screened for seedlings that grew more vigorously than controls after transfer to fluctuating cold conditions according to Example 2. Seven candidates were chosen from this megapool. ME00572 was represented two times in this set.

Four events of ME00572 showed significant tolerance under cold fluctuating conditions in at least two generations. The seedling area of transgenic plants within a seed line was compared to that of non-transgenic segregants within the same seed line after 14 days of growth at fluctuating temperatures of 8° C. and 1° C. Five events of ME00572 were analyzed as described in the Cold Flux Assay described in Example 2. Events −01, −03, −04 and −05 were significant in at least two generations at p<0.05 using a one-tailed t-test assuming unequal variance (Table 4). The transgenic plants were visibly larger than the controls.

Events −01 and −05 segregated 3:1 (R:S) for Finale™ resistance in the T2 generation. Event −04 segregated 3:1 in the T3 generation. Event −03 segregated 1:1 in the T2 generation.

TABLE 3 t-test comparison of seedling area between transgenic seedlings and control non-transgenic segregants after 10 days at 8° C.

| Events | Event-Gen | Transgenic | | | Control Non-Transgenics[a] | | | t-test |
|---|---|---|---|---|---|---|---|---|
| | | Avg | SE | N | Avg | SE | N | p-value |
| ME17294-08[b] | 08-T2 | 0.0032 | 0.0003 | 24 | 0.0022 | 0.0002 | 9 | 2.57E−03 |
| ME17294-08 | 08-T2 | 0.0021 | 0.0001 | 41 | 0.0018 | 0.0001 | 10 | 4.52E−03 |
| ME17294-08-02[a] | 08-T3 | 0.0083 | 0.0003 | 48 | 0.0064 | 0.0002 | 234 | 3.05E−08 |
| ME17294-08-04 | 08-T3 | 0.0075 | 0.0003 | 54 | 0.0064 | 0.0002 | 234 | 9.19E−04 |
| ME17294-09[b] | 09-T2 | 0.0058 | 0.0003 | 22 | 0.0035 | 0.0002 | 9 | 1.02E−06 |
| ME17294-09 | 09-T2 | 0.0039 | 0.0002 | 41 | 0.0029 | 0.0002 | 16 | 4.59E−04 |
| ME17294-09-01[a] | 09-T3 | 0.0073 | 0.0003 | 46 | 0.0064 | 0.0002 | 234 | 5.53E−03 |
| ME17294-09-04[a] | 09-T3 | 0.0087 | 0.0003 | 63 | 0.0064 | 0.0002 | 234 | −9.10E−11 |

[a]Transgenic seedlings were compared to internal non-transgenic segregants within a seed line except for the $T_3$ generation of Events -08 and -09. Since these seed lines were homozygous, they were compared to pooled non-transgenic segregants from another $T_3$ generation event that was grown in the same flat as the $T_3$ generation of Events -08 and -09.
[b]These events were sown twice. The first time was to identify ME17294 as a Hit. They were repeated the second time with two generations to identify ME17294 as a Lead.

TABLE 4 t-test comparison of seedling area between transgenic seedlings and control
non-transgenic segregants after 14 days fluctuation between 8° C. and 1° C.

| Events | Event-Gen | Transgenic Avg | SE | N | Control Non-Transgenics[a] Avg | SE | N | t-test p-value |
|---|---|---|---|---|---|---|---|---|
| ME00572-01 | -01-T2 | 0.0338 | 0.0293 | 26 | 0.0233 | 0.0010 | 4 | 0.155617 |
| ME00572-01[b] | -01-T2 | 0.0541 | 0.0021 | 45 | 0.0442 | 0.0030 | 13 | 4.92E-03 |
| ME00572-01-01 | -01-T3 | 0.0347 | 0.0017 | 40 | 0.0246 | 0.0014 | 14 | 1.53E-05 |
| ME00572-01-02[c] | -01-T3 | 0.0331 | 0.0013 | 59 | 0.0267 | 0.0005 | 294 | 2.35E-06 |
| ME00572-01-03[c] | -01-T3 | 0.0360 | 0.0010 | 59 | 0.0267 | 0.0005 | 294 | -9.39E-11 |
| ME00572-01-04 | -01-T3 | 0.0329 | 0.0013 | 46 | 0.0233 | 0.0018 | 14 | 3.19E-05 |
| ME00572-03 | -03-T2 | 0.0312 | 0.0016 | 11 | 0.0223 | 0.0013 | 19 | 9.71E-05 |
| ME00572-03[b] | -03-T2 | 0.0383 | 0.0024 | 24 | 0.0341 | 0.0023 | 25 | 1.04E-01 |
| ME00572-03-01 | -03-T3 | 0.0328 | 0.0014 | 30 | 0.0236 | 0.0008 | 28 | 1.42E-07 |
| ME00572-03-02 | -03-T3 | 0.0311 | 0.0010 | 26 | 0.0261 | 0.0015 | 33 | 3.81E-03 |
| ME00572-03-03 | -03-T3 | 0.0352 | 0.0011 | 28 | 0.0252 | 0.0009 | 32 | 1.39E-09 |
| ME00572-03-04 | -03-T3 | 0.0331 | 0.0019 | 23 | 0.0260 | 0.0014 | 35 | 1.97E-03 |
| ME00572-04-99 | -04-T3 | 0.0235 | 0.0009 | 23 | 0.0158 | 0.0020 | 7 | 6.98E-04 |
| ME00572-04-99[b] | -04-T3 | 0.0336 | 0.0012 | 31 | 0.0255 | 0.0010 | 29 | 2.01E-06 |
| ME00572-04-99-01[c] | -04-T4 | 0.0388 | 0.0014 | 57 | 0.0267 | 0.0005 | 294 | -9.39E-11 |
| ME00572-04-99-02 | -04-T4 | 0.0345 | 0.0011 | 41 | 0.0253 | 0.0018 | 19 | 3.93E-05 |
| ME00572-04-99-03[c] | -04-T4 | 0.0433 | 0.0012 | 60 | 0.0267 | 0.0005 | 294 | -3.33E-16 |
| ME00572-04-99-04 | -04-T4 | 0.0315 | 0.0010 | 44 | 0.0239 | 0.0012 | 16 | 3.22E-06 |
| ME00572-05 | -05-T2 | 0.0362 | 0.0020 | 19 | 0.0219 | 0.0020 | 10 | 1.13E-05 |
| ME00572-05-01[c] | -05-T3 | 0.0337 | 0.0011 | 57 | 0.0267 | 0.0005 | 294 | 6.21E-09 |
| ME00572-05-02 | -05-T3 | 0.0320 | 0.0014 | 39 | 0.0232 | 0.0020 | 17 | 3.59E-04 |
| ME00572-05-03[c] | -05-T3 | 0.0379 | 0.0011 | 59 | 0.0267 | 0.0005 | 294 | -9.39E-11 |
| ME00572-05-04 | -05-T3 | 0.0344 | 0.0020 | 37 | 0.0268 | 0.0022 | 19 | 7.26E-03 |

[a]Transgenic seedlings were compared to internal non-transgenic segregants within an event unless otherwise indicated.
[b]These events were sown twice. The first time was to identify ME00572 as a Hit. They were repeated the second time with the next generation to identify ME00572 as a Lead.
[c]These events did not segregate non-transgenic seedlings and were compared to pooled non-transgenics for the line.

Plants from Events -01, -03, -04 and -05 which are hemizygous or homozygous for clone 13209 do not show any negative phenotypes under standard conditions. Events -01, -03, -04 and -05 of ME00572 were tested for negative phenotypes compared to the empty vector control SR00559. There was no detectable reduction in germination rate, the plants appeared wild-type in all instances, and there was no statistical differences between experimentals and controls for days to flowering, rosette area 7 days post-bolting, and fertility (silique number and seed fill).

Example 7

Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al., Proc. Natl. Acad. Sci. USA, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NO:2, 20, 74, 93, and 116, are shown in FIGS. 1-5, respectively. Additional exemplary homologs are correlated to certain Figures in the Sequence Listing.

Example 8

Determination of Functional Homologs by Hidden Markov Models

Hidden Markov Models (HMMs) were generated by the program HMMER 2.3.2. To generate each HMM, the default HMMER 2.3.2 program parameters, configured for glocal alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO:2.

The procedure above was repeated and an HMM was generated for each group of sequences shown in FIGS. 2, 3, 4, and 5 using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (260 sequences)

SEQ ID NO: 1 - DNA, 621 bp, Arabidopsis thaliana
  misc_feature: Ceres SEEDLINE ID no.ME00327
  misc_feature: Inplanta Sequence
  misc_feature: Encodes the peptide sequence at SEQ ID NO. 2
actagttagttgaaatggaggctttcaagcttcggatccaacgcacgtaatctctctctctctctctcttctctcttttttctttctctcttctttctctctgtaaaacttgtctaatggcagagatctgctgcgtcaaagagatccaagaagaagacgtggagaagatccgattaccgacccgacccgaattagacattcctgtctctgatcacgaagatccaacggtcaacgaagaagaagggtgcaagactccaacatcgtccgatcacaagattccggaggtgaagtatacgttatgtccaccggctccgagaaaaccaaaaccgaatcgatcttccggtacgaaacggaaattaacgccggttaatgttcttaaccgcataccgattgatctgagccgtgagatcgagatgttcttcgaggatttggaccgtaggatcaagaagtcacggaaacaataagaagattattgccttaattggtaatgatcgttcatttctaattcatgactgtgtggtggtaatttgatcctttgaatttttcttcattttttttttcttttttttttcgttttctgtataattaattagctaataacaataagaaaatttatgtacc

SEQ ID NO: 2 - protein, 115 aa, Arabidopsis thaliana
  misc_feature: Ceres SEEDLINE ID no.ME00327
  misc_feature: Bit score of 224.6 for hmm based on sequences of FIGURE 1.
MAEICCVKEIQEEDVEKIRLPTRPELDIPVSDHEDPTVNEEEGCKTPTSSDHKIPEVKYTLCPPAPRKPKPNRSSGTKRKLTPVNVLNRIPIDLSREIEMFFEDLDRRIKKSRKQ

SEQ ID NO: 3 - DNA, 992 bp, Gossypium hirsutum
  misc_feature: Ceres CLONE ID no.1897908
  misc_feature: Encodes the peptide sequence at SEQ ID NO 4
gggttgtcaaagccttttctctgtctctcatctttgccttctctttctcatttcgcagctaaattccaaactaaaatccaagatagaaaaagaaattcagagaacaatcaaggaagatggtgatgtgatgaattaaaaaaaagaaaaaccctctggcattttcgtttcctatatatcaaataccaagcttcttctctttgtttttctaggcttttttttcctgctggtacttgtactgtcttttccttcatttgcttgcaattttcataatttgatccctctctctaatctttaaattctttgtcttcatcatttcttcatatcctaggttgattttggacttccatgtactcaaaattaaaaccagttccattcatgggtgtctcaactaccatggaactcagtttcttggttaggcctcctctagaattcaatgaagattgtggaactgcaactaatgttaaacaagaagaagaagaagagaagagcaagttggtgatgatgggtacatctgaatctgaggtggttgctgctgctaatgatgatcaagatgaaaacgacaacgatgggttcaagactcctacttcgttcgaccataaaatcccagccgccaccatcctcaagtgcccacctgcaccaaggaaaccaaaatccctccccattatatcgtcaccagcaaaacgaaaatcgcttcgcaggagaatcctacttgatttgacgaaagagatcgagtctttgttccctccagctcttattgcagatctagggaacaagattaagaaagtcagacaaggaagtgacttcaaatgatatgatatatatatacatatatacatacaaatataactatatatgtatcatgtatttatttgaagaattttaattatgttatttgttttcatcatccaagaccatcacatctatgttcagtttcattgatgtgttttttatttggtgtttctatcagatctaaaaccatataaagactttgc

SEQ ID NO: 4 - protein, 154 aa, Gossypium hirsutum
  misc_feature: Ceres CLONE ID no.1897908
  misc_feature: Bit score of 132.4 for hmm based on sequences of FIGURE 1.
  misc_feature: Functional Homolog Of Ceres SEEDLINE ID no. ME00327 at SEQ ID NO. 2
MYSKLKPVPFMGVSTTMELSFLVRPPLEFNEDCGTATNVKQEEEEEKSKLVMMGTSESEVVAAANDDQDENDNDGFKTPTSFDHKIPAATILKCPPAPRKPKSLPIISSPAKRKSLRRRILLDLTKEIESLFPPALIADLGNKIKKVRQGSDFK

SEQ ID NO: 5 - DNA, 1175 bp, Gossypium hirsutum
  misc_feature: Ceres CLONE ID no.1938030
  misc_feature: Encodes the peptide sequence at SEQ ID NO 6
aaaagtgggttgtcaaagccttttctctgtctctcatctttgctttctctttctcatttcgcagctaaattccaaactaaaatccaagatagaaaaagaaattcagagagcaatcaaggaagatggtgatgtgatgaattaaaaaaaaaaactttggcattttcgtttactatatatcaaataacaagcttcttctctttgtttttctaggctttttttttcctgctggtacttgaactgtcttttccttcatttgcttgcaattttcataagttgatccctctctctcatctttaaattctttgtccttcaccatttcttcatatcctaggttgattttggacttccatgtactcaaaattaaaaccagttccattcatgggtgtctcaagtaccatggaactcagtttcttggttaggcctcctctagaattcaatgaagattgtggaactgcaactaatgttaaacaggaagaagaagaagagaagagcaagttggtgacgatgggtacatctgaatctgaggtggttgctgctgctaatgattatcaagatgaaaacgacaacgatgggttcaagaccaacgatgggttcaagactcctacttcattggaccataaaatcccagccgccgccatcctcaagtgcccacctgcaccaaggaaaccaaaatccctccccattatatcgtcaccagcaaaacgaaaatctcttcgcaggagaatcctgcttgatttgacgaaagagatcgagtctttgttccctccagctcttattgcagatctagggaacaagattaagaaagtcagacaaggaagtgacttcaaatgacatgatacatatacatatatacatacatacaaatataactatatatgtgtcatgtatttatttgaagaattttaattatgttatttgttttcatcatcctagaccatcacttctatgttcagtttcattggtgtgttttttatttggtgtttctatcagatctaaaaccatacaaagactttgcaaaatggatcaaagcaagtacaaagtgagtgatgtgattcatggattttagcattgggttctttactttctttttcttttggctgcactcttaacctagctaaaagatgaacttttgaggtttgattttaaatttaattagagctacatataattatacg

SEQ ID NO: 6 - protein, 160 aa, Gossypium hirsutum
  misc_feature: Ceres CLONE ID no.1938030
  misc_feature: Bit score of 131.1 for hmm based on sequences of FIGURE 1.
  misc_feature: Functional Homolog Of Ceres SEEDLINE ID no. ME00327 at SEQ ID NO. 2
MYSKLKPVPFMGVSSTMELSFLVRPPLEFNEDCGTATNVKQEEEEEKSKLVTMGTSESEVVAAANDYQDENDNDGFKTNDGFKTPTSLDHKIPAAAILKCPPAPRKPKSLPIISSPAKRKSLRRRILLDLTKEIESLFPPALIADLGNKIKKVRQGSDFK

SEQ ID NO: 7 - DNA, 781 bp, Gossypium hirsutum
  misc_feature: Ceres CLONE ID no.1915941
  misc_feature: Encodes the peptide sequence at SEQ ID NO 8
tcgctcgctcgctgggttaaaactgtttcgtcctattttctctcttaactgtagaaacaaagtctggaattgtacaactccaccagggggaaggatggtgatttgatgatttaccatattgctttatgttatacattctcatcgctttttatctgtttgcactaatgtatgtagaattgcggctgcctgcaggtttcccttgtcggtatctcgagttcagagacggccgtagtcaaaggtggtgaagaaggaatggaattcgacattctgaaacgacccctaccggtgaagtgccaaactacaacctcttcttctttttcacccggtaaacaacaaaaagaagaaggagaaatcaacgttaaagcagctggtgaggggaaggaagagaagaaagaaaagaattccaaggaaatagatgatgatgatgatgatgggtttaaaactccaacatctacggattccaaaatcccagctgagccgaaacaatgcccgcctgcacctagaaaacccaagccaaataaaagaaaagcatcatcgcctaccaatggttcaaccgcagtcaggaatccgctactgctggatctttcggaagagctcgagtccttgagtcacaaggtcaagaaaaaaactcgaacacaagagcagcaataatttttattcattgttagcggtattaagtacacacccatcaaacattaataacttaattctttatttgtatttatgggagttcattgtttttgctgacggtgaagatcatgatgatattgaagcttatgac

SEQ ID NO: 8 - protein, 132 aa, Gossypium hirsutum
  misc_feature: Ceres CLONE ID no.1915941
  misc_feature: Bit score of 254.1 for hmm based on sequences of FIGURE 1.
  misc_feature: Functional Homolog Of Ceres SEEDLINE ID no. ME00327 at SEQ ID NO. 2
MEFDILKRPLPVKCQTTTSSSFSPGKQQKEEGEINVKAAGEGKEEKKEKNSKEIDDDDDDGFKTPTSTDSKIPAEPKQCPPAPRKPKPNKRKASSPTNGSTAVRNPLLLDLSEELESLSHKVKKKTRTQEQQ

SEQ ID NO: 9 - DNA, 483 bp, Populus balsamifera subsp. trichocarpa
  misc_feature: Ceres ANNOT ID no.1461830
  misc_feature: Encodes the peptide sequence at SEQ ID NO 10
atggggttttccaactctgagatgtttttctctgagaaagatctgaatcccatggaattcaatttccttgtgagatctgcattagaacttggagatgactgtgaaattgtaccccaagatcttcatcaggaaaaagaagtacttgaaaaagaagaaaagcaagaagacgaatgcgagatatcggtgcctactttgaagataaaactgccgtctgtagaagcattccaaattgaagatgataaagatgacgatgatgatgggttcaagactccaacttctttggatcgcaaaattcctgtcatttttcaatgtccgcccgcacccagaaaacctaaatcactcccatcagccaaacgaaaatcgcctcaacggagagtcttacttgatctgtccaatgagatcgaatccttgtttcctccagctcttgctggggatcttggtggcaagattaagaaagttagacaaggcaatgacaccaagtaa

SEQ ID NO: 10 - protein, 143 aa, Populus balsamifera subsp. trichocarpa
  misc_feature: Ceres ANNOT ID no.1461830
  misc_feature: Bit score of 305.4 for hmm based on sequences of FIGURE 1.
  misc_feature: Functional Homolog Of Ceres SEEDLINE ID no. ME00327 at SEQ ID NO. 2
MEFNFLVRSALELGDDCEIVPQDLHQEKEVLEKEEKQEDECEISVPTLKIKLPSVEAFQIEDDKDDDDDGFKTPTSLDRKIPVIFQCPPAPRKPKSLPSAKRKSPQRRVLLDLSNEIESLFPPALAGDLGGKIKKVRQGNDTK

SEQ ID NO: 11 - DNA, 561 bp, Populus balsamifera subsp. trichocarpa
  misc_feature: Ceres ANNOT ID no.1439985
  misc_feature: Encodes the peptide sequence at SEQ ID NO 12
atggctgacccgataaagagtgaacctcattctcaaagcgaaggtttttctgccatgttctcggaatcgaaaccattttcgttaacggggttgcctaactctcagatttttttctctgagaaagatccgaatcctaaggaattcaatttccttgtgagacccacgttagaacttggagatgacggtgaaactgtacctcaagagcttcatcaggaaaaagaagttgaagaagaaggaaagcaagaagataaatgcgagatctcggtacctactttgaagataaaattcccatctttaggagctttccaaattgaagatagtgatcatggtgatggttcgaagactccaacttcttcggattgcaaaatccctgtcatttttcaatgtccgcctgcacctataaaacctaaatcacttccatcaaccaaacgaaaatcgcctcgacggagagtcttacttgatctgtccaacgaggttgaaactttgtttcccccagctcttgctgcaaatcttggtggcaagattaagaaagttagacaaggcaacgacagtaccaaataa

SEQ ID NO: 12 - protein, 168 aa, Populus balsamifera subsp. trichocarpa
  misc_feature: Ceres ANNOT ID no.1439985
  misc_feature: Bit score of 220.9 for hmm based on sequences of FIGURE 1.
  misc_feature: Functional Homolog Of Ceres SEEDLINE ID no. ME00327 at SEQ ID NO. 2
MFSESKPFSLTGLPNSQIFFSEKDPNPKEFNFLVRPTLELGDDGETVPQELHQEKEVEEEGKQEDKCEISVPTLKIKFPSLGAFQIEDSDHGDGSKTPTSSDCKIPVIFQCPPAPIKPKSLPSTKRKSPRRRVLLDLSNEVETLFPPALAANLGGKIKKVRQGNDSTK

SEQ ID NO: 13 - protein, 115 aa, Arabidopsis thaliana
  misc_feature: Public GI ID no.15241794
  misc_feature: Bit score of 218.0 for hmm based on sequences of FIGURE 1.
  misc_feature: Functional Homolog Of Ceres SEEDLINE ID no. ME00327 at SEQ ID NO. 2
MAEICCVKEIQEEDVEKIRLPTRPELDIPDSDHEDPTVNEEEGCKTPTSSDHKIPEVKYTLCPPAPRKPKPNRSSGTKRKLTPVNVVNRIPIDLSREIEMFFEDLDRRIKKSRKQ

SEQ ID NO: 14 - DNA, 678 bp, Brassica napus
  misc_feature: Ceres CLONE ID no.1080942
  misc_feature: Encodes the peptide sequence at SEQ ID NO 15
ctaagaagatttgttcagtgcacacgacaaaacacaaaaacaaaaccttcaagaacaactccatttaaatatctataaagaaatgaatcttgatttaatacaagatctgcccatgctgaagttcccatcacccatcaagatcccatccaacaacaccaacagagatgatgacggcagcagcggcggctgcaccactcccacttcctccgaccacaagattcctccctccaccgccactactcctcctcctccgcctcagaaacgccgcccacctccgtcgccatcatgtttcatcagatcttgcaagaggaagcttttgacgccatcaaaggttgagatcatcgtcaacaaagatgagatcgaacggttcttctcctctgtttacaatcactcaacgacgtcatcccccacaacaaccaccaccaaaaaggctctcgcggtggttaggcgacggagaagtttccgttcttgttcacgaagatgatcaataattggagttaaccacaataaagttaaaggttccttcatttcggtaactttttatttattttatgtaacgattctcaactttacacgtcgacccactctataaatatacatgtgctatcgatcgttggaatctttcttttcttaatagcttcatgaattatgtaaatgttcaataaatttatatttgct

SEQ ID NO: 15 - protein, 133 aa, Brassica napus
  misc_feature: Ceres CLONE ID no.1080942
  misc_feature: Bit score of 274.7 for hmm based on sequences of FIGURE 1.
  misc_feature: Functional Homolog Of Ceres SEEDLINE ID no. ME00327 at SEQ ID NO. 2
MNLDLIQDLPMLKFPSPIKIPSNNTNRDDDGSSGGCTTPTSSDHKIPPSTATTPPPPPQKRRPPPSPSCFIRSCKRKLLTPSKVEIIVNKDEIERFFSSVYNHSTTSSPTTTTTKKALAVVRRRRSFRSCSRR

SEQ ID NO: 16 - DNA, 623 bp, Glycine max
  misc_feature: Ceres CLONE ID no.1073190
  misc_feature: Encodes the peptide sequence at SEQ ID NO 17
aacaagttttctacatccacacaaaaaaggttttccaaacataagcacacatttacagacatggatgatcttgagttattacaagatctgtcccaattcaacttcccagcaaccatcaagatcccatctaaaacctctaaagacaacaaagacggcgatggtgataacgacgagggctttagctgcagcacacccacatctcaagaacacaagattccttctgtccacgattctccacctcccccgccgagaaaacctcgtgcactgccttcaaaaccgtcgcctacggcggctctggtgataagatcgtgtaagaggaagctcttagtgtcggctcctgagattatcatgaacaaggaagagattgaccgtttcttctcctctgtctatagtgacacgtcaacgacggctaaacggcggagacgttatctttattgtgcgcgaagatgagcctttagttcaagatttacattttctacagttttactggaaatatataaattaaaaaccttattataagtattttaattttcaaaatggatggataattttctgtagccgcatattaattccgcatggaggggtcgttgttgtaaattccgtaataaatgaaatttaattcc

SEQ ID NO: 17 - protein, 129 aa, Glycine max
  misc_feature: Ceres CLONE ID no.1073190
  misc_feature: Bit score of 272.3 for hmm based on sequences of FIGURE 1.
  misc_feature: Functional Homolog Of Ceres SEEDLINE ID no. ME00327 at SEQ ID NO. 2
MDDLELLQDLSQFNFPATIKIPSKTSKDNKDGDGDNDEGFSCSTPTSQEHKIPSVHDSPPPPPRKPRALPSKPSPTAALVIRSCKRKLLVSAPEIIMNKEEIDRFFSSVYSDTSTTAKRRRRYLYCARR

SEQ ID NO: 18 - DNA, 1377 bp, Arabidopsis thaliana
  misc_feature: Ceres SEEDLINE ID no.ME04315
  misc_feature: Expected Sequence
  misc_feature: Encodes the peptide sequence at SEQ ID NO. 20
aaaaaacttcaaagagagagagagagagagttttgtgaactcaagaaaataaaaaaagttatagttaatgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcacttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctgattcgaatctacggtggataaacaatcaacctgaagacttcatatcttccaccgttgatttacagtcggtgtataataagtatagtgagtcttaccgtagacaaacatcttatcctctttaccgttttaattactttttttttacgcgctctcactgccactgtaactcttttttttttcttcctatatatgtatgcttatttttatttagaaaatgttatgaaatcatataatttggtaatc

SEQ ID NO: 19 - DNA, 1377 bp, Arabidopsis thaliana
  misc_feature: Ceres SEEDLINE ID no.ME04315
  misc_feature: Inplanta Sequence
  misc_feature: Encodes the peptide sequence at SEQ ID NO. 20
aaaaaacttcaaagagagagagagagagagttttgtgaactcaagaaaataaaaaaagttatagttaatgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcacttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctgattcgaatctacggtggataaacaatcaacctgaagacttcatatcttccaccgttgatttacagtcggtgtataataagtatagtgagtcttaccgtagacaaacatcttatcctctttaccgttttaattactttttttttacgcgctctcactgccactgtaactcttttttttttcttcctatatatgtatgcttatttttatttaaaaaatgttatgaaatcatataatttggtaatc

SEQ ID NO: 20 - protein, 355 aa, Arabidopsis thaliana
  misc_feature: Ceres SEEDLINE ID no.ME04315
  misc_feature: Bit score of 860.9 for hmm based on sequences of FIGURE 2.
  misc_feature (285)..(329): Pfam Name: CCT Pfam Description: CCT motif
  misc_feature (56)..(103): Pfam Name: zf-B_box Pfam Description: B-box zinc finger
MGFGLESIKSISGGWGAAARSCDACKSVTAAVFCRVDSAFLCIACDTRIHSFTRHERVWVCEVCEQAPAAVTCKADAAALCVTCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 21 - DNA, 1541 bp, Gossypium hirsutum
  misc_feature: Ceres CLONE ID no.1842825
  misc_feature: Encodes the peptide sequence at SEQ ID NO 22
aagagcaaactgtggcactactccatgtatactcccaaaatctctaaaaagggaaatactagtcctttcgagggcaactgaaagaggagaaaaaaaaatctattggttttgatttgtgaggatggtaatcgatacaaccaacgtcaagggacttacgggacgctggggcatggcagcaaagacatgcgacacatgtaaatcagcggcagcggctattttctgtcgttctgattccgcttttatgtgcctcagctgcgattccaggatccactctgctaatgacaagcttgtttcttgtcgtcacgagagggtgtggatgtgtgaggtgtgcgagcaggccccagctgccgtcacttgcaaggccgacgccgctgccctttgcgtcgcctgcgattccgacatccactctgctaatcctttggctcgtcgccacgagcgtgtccctgtccagcctttctttgactctgctgattccatcgtcaaatcttcttctttcagcttccttgtgccgactgatcctaatactggttctaattgtcaacaagaagatgtagagacaggttcttggctgttgcccaatcccaaactcaccatggaaactaaccaagtcaaaacaggggattttttcttctccgacatggatccgtttattgattttgagtaccaggattcgtttcaacagcatgacggagctatggacagcgtagttccagttcagaccaaaccagctacaatttcaatgatcaacaatgaaaattgtttcgatgttgatttctgtcgatccaagttccctactttcagctaccagacaaagtctcaaagccatagtgtttcatcatcgtcgctcgaggtaggagtagttccagatgggaactccgtgtcggatatctcatatactttgggacggaccatgggtgacccaagcgcaccaatctgggcagctacagccaataaccaagcaccacctcaggcccaagtcggtggaatggatcgagaagctagagttctaaggtacagagagaagagaaagaacagaaaatttgagaaaacaatccgctacgcttcgagaaaggcatacgccgagtcaaggccaaggatcaaaggccgtttcgccaaaagaaatgaaaccgacaacgaagttgaccacatgtataactcggcttcttccgctgctaccgcagcagctttcatgtacgataaccagtacggcatcgtcccatccttttgaggatgtcatgaatgaatctgattcagatggaaacaagaattgttggctgtaatattcaactgtgatatatatatccagcaagtagaatcaactaccctaaggaaaacaaatgatgtagcttttaattatggttattgatgtaaaaatagtgtatccatgagctattgatttgcagggattcattcaagttgattaactgcagaataagatggaaaagtcctgcaaaatctgaaacaaagcccttccactttttctctagagggcttcttctgtgattctgttatctagaagtaaaagtttttcttggtttttc

SEQ ID NO: 22 - protein, 368 aa, Gossypium hirsutum
  misc_feature: Ceres CLONE ID no.1842825
  misc_feature: Bit score of 932.9 for hmm based on sequences of FIGURE 2.
  misc_feature (291)..(335): Pfam Name: CCT Pfam Description: CCT motif
  misc_feature (62)..(109): Pfam Name: zf-B_box Pfam Description: B-box zinc finger
  misc_feature: Functional Homolog Of Ceres SEEDLINE ID no. ME04315 at SEQ ID NO. 20
MVIDTTNVKGLTGRWGMAAKTCDTCKSAAAAIFCRSDSAFMCLSCDSRIHSANDKLVSCRHERVWMCEVCEQAPAAVTCKADAAALCVACDSDIHSANPLARRHERVPVQPFFDSADSIVKSSSFSFLVPTDPNTGSNCQQEDVETGSWLLPNPKLTMETNQVKTGDFFFSDMDPFIDFEYQDSFQQHDGAMDSVVPVQTKPATISMINNENCFDVDFCRSKFPTFSYQTKSQSHSVSSSSLEVGVVPDGNSVSDISYTLGRTMGDPSAPIWAATANNQAPPQAQVGGMDREARVLRYREKRKNRKFEKTIRYASRKAYAESRPRIKGRFAKRNETDNEVDHMYNSASSAATAAAFMYDNQYGIVPSF

SEQ ID NO: 23 - DNA, 1332 bp, Gossypium hirsutum
  misc_feature: Ceres CLONE ID no.1834027
  misc_feature: Encodes the peptide sequence at SEQ ID NO 24
ttaaaatcaataacaaacacttcaaaccctccacgtttgatccaaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtagaaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgatttgctaaaagaacagaaacccacaacgatgatgttgatcacatgttcaataactcttctttcgctgttggtcctgctggtttcatggcggaaacagactatggtgtcgttccatcgttttgaatgttgatgttttatgtttggtttaatctgtaatgtattaaattatttaatccaatttccagcaaagtagaaataaccttatggccattgaaaatcaaggaagaaagatgcttagttctttgattaatcattaaagtttctgatgtataaaaaacagtgtatcggtggagttcgtcgtatgttcgccatggttgatttgcaggattcctgcaagggagatatattagttttcataaaaatgtttatttcaatctctgaataaaaccagatatatggtaagtaaatgcttcaatttagttc

SEQ ID NO: 24 - protein, 313 aa, Gossypium hirsutum
  misc_feature: Ceres CLONE ID no.1834027
  misc_feature: Bit score of 543.8 for hmm based on sequences of FIGURE 2.
  misc_feature (235)..(279): Pfam Name: CCT Pfam Description: CCT motif
  misc_feature (64)..(106): Pfam Name: zf-B_box Pfam Description: B-box zinc finger
  misc_feature: Functional Homolog Of Ceres SEEDLINE ID no. ME04315 at SEQ ID NO. 20
MGIEISGGTIIPGGWGAAAMAVAAKTCDACKSSAAAIFCRTDWVFLCLNCDSNFHSGHERVSMCEVCEQAPAAVTCKADAAALCVTCDADIHSANPLARRHERVPIEPFYDSADSIVKSSPFSFLVPTTDHNGTNCKQEIESNKGDFFFTEMDRFIDFGYPNSSQHLHDAAMDSVVPVQTPKPVIPLINDGSCFDTFSYQTQSSLSHSVSSSSLEVETVPDGNYHATQVGGSIDREARVLRYKEKRKNRKFEKTIRYASRKAYAESRPRIKGRFAKRTETHNDDVDHMFNNSSFAVGPAGFMAETDYGVVPSF

SEQ ID NO: 25 - DNA, 1226 bp, Gossypium hirsutum
  misc_feature: Ceres CLONE ID no.1837064
  misc_feature: Encodes the peptide sequence at SEQ ID NO 26
gattccaaagatctcaccccatcaactgaaatggctgcaaagcattcggacgcctgtaaaccaacagctaccgatccagattttatgtgcctgagttatgattcttccaccgccatccatggctgcattgggagggtgttgatgtgcgacgtttgcgagcaagttccggctgcgttcacttgcaaagccgatgccgccgcgctttgtgtcgcttgtgatgccgatattcactccgctaatcatttggctcgtcgtcactaccgtgtcccgatcgacccttttcttggtccacaaaaagaggatgtagtagtgatgggttcttggtctttgttacctggtttcaatcataaactggttgaaacagaggatttggggatttcagaaatggatccatttattgatttggagtaccaggatggatatcatgttttacagcatcataatttaggtatggaaagcttagttccagttcagatcgaaccggcaacaacagttccagtggtcaaccctattcacttctgccaatctcagtctctcagccatagtgtatcgtcatcctcggttgagttaggtgatgggaattctttatcagatatctcatgcccattaagaggtaccacaactgatccaagcatactcatatgcaacaaccaagtagaccaagttggttcaatggatcgagtggctcgggttttgaggtacagagaaaagagaaagaagagaaaatttgagaaaacagttcgttacgcttcacgaaaagcctacgctgaatcaagaccgagaatcaaaggtcgtttcgttaaaagaactcaaatccataaccgagttgaccatctctgtaactcggcaacatcaccatcatcatcaacaacgacatcccacacgcattactacggtatcgtcccatcttttttatgaaagggaaacgtggaaaaatgaaaccaaaaaatttaattttagtgatgatattgtaaaattccactagtttatgtagcaagtagaataataatcccaagtccattaagattgaggaagatattatgtaacccaaataacggtgatgtttttggtagccgttgatatttggggcttttagggttatacgcaagcagatgttagagttctaagaactgatattttgcttgcagttctgaaaaaaatgaagcccttttcaccatttttattgagaggggcttcttttgtttttatgttactaaagtttgacc

SEQ ID NO: 26 - protein, 295 aa, Gossypium hirsutum
  misc_feature: Ceres CLONE ID no.1837064
  misc_feature: Bit score of 317.3 for hmm based on sequences of FIGURE 2.
  misc_feature (217)..(261): Pfam Name: CCT Pfam Description: CCT motif
  misc_feature (34)..(81): Pfam Name: zf-B_box Pfam Description: B-box zinc finger
  misc_feature: Functional Homolog Of Ceres SEEDLINE ID no. ME04315 at SEQ ID NO. 20
MAAKHSDACKPTATDPDFMCLSYDSSTAIHGCIGRVLMCDVCEQVPAAFTCKADAAALCVACDADIHSANHLARRHYRVPIDPFLGPQKEDVVVMGSWSLLPGFNHKLVETEDLGISEMDPFIDLEYQDGYHVLQHHNLGMESLVPVQIEPATTVPVVNPIHFCQSQSLSHSVSSSSVELGDGNSLSDISCPLRGTTTDPSILICNNQVDQVGSMDRVARVLRYREKRKKRKFEKTVRYASRKAYAESRPRIKGRFVKRTQIHNRVDHLCNSATSPSSSTTTSHTHYYGIVPSFL

SEQ ID NO: 27 - DNA, 1155 bp, Populus balsamifera subsp. trichocarpa
  misc_feature: Ceres ANNOT ID no.1482536
  misc_feature: Encodes the peptide sequence at SEQ ID NO 28
atgggaattgaagttgagagcttaaagaacttgaccggaggatggagtgttgcggctaaacgttgcgactcgtgcaaaacggcagctgcagctgcgttttgccgggcggactctgcttttttgtgtctgaattgtgacaccaagattcaccatagtggggtgaacagcaagatcatgtcaaggcacgagcgtgtgtggatgtgtgaggtttgcgagcaagcacccgctgcggttacctgtaaggctgatgcagctgctctttgtgttacttgtgatgctgacatccactctgctaaccctcttgctcgccgtcatgaacgagtccccgtggagcctttttatgactctgctgaatcaattgttaagacttcctcggcgtttaattttctagtgcctggtgatcaaaatggtgtgtctgcatatgatcataacgatgagatcgagggtgtttcgtggttgttgcacggtaatcacacaacacatgaccttaataccaagatcaacatcgagaatcctgttgtcaagactggagatatgtttttctgtgaaatggatccctttcttgattttgagtatcagaattcgatggatgggaggtacaagcagagtcatggtgggggtggtgctggagctgatagcgttgtgcctgtgcaaaacaaaccagctccgcttcccgtgatcgatcataaaaactgctttgatattgatttctgtagatcgaaactcacctctttcagcagctacccctctcagtcccttagccacagcgtttcttcgtcttccctcgatgttggtgttgttcctgatgggaattctatgtccgatatttcgtatcccttcggccgaagcatgaatacttataccgatccaagcatgcccatctcaggttccactacaaatcaagcagcagctcagttagctgggattgaccgcgaagctagagttttgaggtacagagagaaaagaaagaaccgtaaattcgaaaaaaccatacggtatgcttcacgtaaagcttacgcagaaaccaggccaagaatcaaaggccgattcgcgaagcgaaccgaaatggaatccgatatggacaccctatataactctccgagctctgtccctttcctggccgatactcattacggtgtcgttccctcgttttga

SEQ ID NO: 28 - protein, 384 aa, Populus balsamifera subsp. trichocarpa
  misc_feature: Ceres ANNOT ID no.1482536
  misc_feature: Bit score of 969.7 for hmm based on sequences of FIGURE 2.
  misc_feature (311)..(355): Pfam Name: CCT Pfam Description: CCT motif
  misc_feature (63)..(110): Pfam Name: zf-B_box Pfam Description: B-box zinc finger
  misc_feature: Functional Homolog Of Ceres SEEDLINE ID no. ME04315 at SEQ ID NO. 20
MGIEVESLKNLTGGWSVAAKRCDSCKTAAAAAFCRADSAFLCLNCDTKIHHSGVNSKIMSRHERVWMCEVCEQAPAAVTCKADAAALCVTCDADIHSANPLARRHERVPVEPFYDSAESIVKTSSAFNFLVPGDQNGVSAYDHNDEIEGVSWLLHGNHTTHDLNTKINIENPVVKTGDMFFCEMDPFLDFEYQNSMDGRYKQSHGGGGAGADSVVPVQNKPAPLPVIDHKNCFDIDFCRSKLTSFSSYPSQSLSHSVSSSSLDVGVVPDGNSMSDISYPFGRSMNTYTDPSMPISGSTTNQAAAQLAGIDREARVLRYREKRKNRKFEKTIRYASRKAYAETRPRIKGRFAKRTEMESDMDTLYNSPSSVPFLADTHYGVVPSF

SEQ ID NO: 29 - protein, 355 aa, Arabidopsis thaliana
  misc_feature: Public GI ID no.18424009
  misc_feature: Bit score of 856.7 for hmm based on sequences of FIGURE 2.
  misc_feature (285)..(329): Pfam Name: CCT Pfam Description: CCT motif
  misc_feature (56)..(103): Pfam Name: zf-B_box Pfam Description: B-box zinc finger
  misc_feature: Functional Homolog Of Ceres SEEDLINE ID no. ME04315 at SEQ ID NO. 20
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 30 - protein, 351 aa, Arabidopsis thaliana
  misc_feature: Public GI ID no.9759262
  misc_feature: Bit score of 833.0 for hmm based on sequences of FIGURE 2.
  misc_feature (281)..(325): Pfam Name: CCT Pfam Description: CCT motif
  misc_feature (56)..(103): Pfam Name: zf-B_box Pfam Description: B-box zinc finger
  misc_feature: Functional Homolog Of Ceres SEEDLINE ID no. ME04315 at SEQ ID NO. 20
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 31 - DNA, 1428 bp, Glycine max
  misc_feature: Ceres CLONE ID no.463157
  misc_feature: Encodes the peptide sequence at SEQ ID NO 32
aactcactcactcattcaagtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttatg

SEQ ID NO: 32 - protein, 374 aa, Glycine max
  misc_feature: Ceres CLONE ID no.463157
  misc_feature: Bit score of 912.7 for hmm based on sequences of FIGURE 2.
  misc_feature (302)..(346): Pfam Name: CCT Pfam Description: CCT motif
  misc_feature (60)..(107): Pfam Name: zf-B_box Pfam Description: B-box zinc finger
  misc_feature: Functional Homolog Of Ceres SEEDLINE ID no. ME04315 at SEQ ID NO. 20
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 33 - DNA, 1556 bp, Triticum aestivum
  misc_feature: Ceres CLONE ID no.685991
  misc_feature: Encodes the peptide sequence at SEQ ID NO 34
aacttttgcttcgccgtggaagggatcgtcgtagctggcttagcttgctgctttgcttccaagtgttgctgctggtggtgctgtggtagtgtggtgtgaggtgtgatggagctgcaggggctggggaggtactggggcgtgggcggcaggaggtgcgggtcgtgccgggggtcgccggcggcggtgcactgccggacgtgcgatgggggcagtggggacggggcgtacctgtgcgcgggctgtggcgaggggcacgcgcgggcggggcacgagagggtgtgggtctgcgaggtgtgcgagctcgcgccggccgcggtcacctgcaaggccgacgccgccgcgctctgcgccgcctgcgacgccgacatccaccacgccaacccgctcgcgcgccgccacgagcgcgtccccgtgcagcccatcgggtcctcgtcacccgaggggcaggagcaggagcaggatgcgttcgtgatgtcgttcggcggctcggtcgacggggagaagcagcagaaccccgtggtgaacctgaacgacgctctggaggccggcgccggcgggaaggagaacgtgaagctggacttcctgttcgcggacatgatggaccctttcttcggctccgagctcccgcgcttcccgcacgccgacagcgttgtccccagcggcggcgcggtggagctggacttcggtggcgtcgccgcccccgtcgtcgtctccaacccgtcctacagctcctacacggcggcgtcgctcggtggaagtggctcgtcgtcggaggtcggcttggtgccggacgcgatctgtggccgaggcggcggcatcatcgagctggacttcgcacagtccaaggccgcgtacctgccctacacccccacaccaagccacagtaccgtctcctcggtggatgttgggtcggtgccggagcggagcgacagcgccgtcgcggcggcgacgccggcgacgggggaggggagggaggcgcgtctgatgcggtaccgcgagaagcgcaagaaccggcggttcgagaagaccatccggtacgcgtcccggaaggcctacgccgagagcaggccgcgcgtcaagggccgcttcgccaagcgcgccgacgacgcggacaccgacgccgtcgcggcggccacgatcaccacgccggggccatgcgtgctcgacttcggcagctacggcgtcgtgcccaccttctgaggcggcgcctgatttcgtgtccatttcctccggcgagcgtgccggctgggtgcctaattaaatccggcaccgccatggccggcacgagcgcgccgacgtgcatgcgtcgtgttccctcttgtataattgcatgtaatgtttttcgagctggctgatcgctggctggcgtgtagtatactgtaatcaacatgcacgcacgcacgcacgcatgttttgctagaactagaataatacagatagttctagttgactagtctactaccctgtaccctttccctgggctagcttgatgccaaattaggctagggcaatgtaacgtgtttgctggaacagcttagttctagttttggatccgc

SEQ ID NO: 34 - protein, 364 aa, Triticum aestivum
  misc_feature: Ceres CLONE ID no.685991
  misc_feature: Bit score of 464.6 for hmm based on sequences of FIGURE 2.
  misc_feature (289)..(333): Pfam Name: CCT Pfam Description: CCT motif
  misc_feature (56)..(103): Pfam Name: zf-B_box Pfam Description: B-box zinc finger
  misc_feature: Functional Homolog Of Ceres SEEDLINE ID no. ME04315 at SEQ ID NO. 20
MELQGLGRYWGVGGRRCGSCRGSPAAVHCRTCDGGSGDGAYLCAGCGEGHARAGHERVWVCEVCELAPAAVTCKADAAALCAACDADIHHANPLARRHERVPVQPIGSSSPEGQEQEQDAFVMSFGGSVDGEKQQNPVVNLNDALEAGAGGKENVKLDFLFADMMDPFFGSELPRFPHADSVVPSGGAVELDFGGVAAPVVVSNPSYSSYTAASLGGSGSSSEVGLVPDAICGRGGGIIELDFAQSKAAYLPYTPTPSHSTVSSVDVGSVPERSDSAVAAATPATGEGREARLMRYREKRKNRRFEKTIRYASRKAYAESRPRVKGRFAKRADDADTDAVAAATITTPGPCVLDFGSYGVVPTF

SEQ ID NO: 35 - DNA, 1442 bp, Triticum aestivum
  misc_feature: Ceres CLONE ID no.702632
  misc_feature: Encodes the peptide sequence at SEQ ID NO 36
acctcagatcaatcactcttccctcccactactcccaccgcgttcacccgccattgcctgtcgaagctacgagattagttactagtatgatggagctgcgcaagtactggggcgtgggggggaggaggtgcggggcgtgcgagggggcggcgccggcggcggtgcactgccgggattgcgccgggtacctgtgcacggggtgcgacgcgcggccggcgcacgcgcgggctggccacgagcgcgtctgggtgtgcgaggtctgcgaggtcagccccgcggccgtgacgtgcaaggccgacgccgccgtgctctgcgccgtgtgcgacgccgacatccaccacgccaacccgctcgccgagcgccacgtgcgcgtgcccatcgcgcccatctgctcccccgaggccgccgcggtggcggccgaggccatgatgttctgtggcgccggtgacggcgaggcgcgggcggatcaggacgacgtgcccgagcagctgcaccaacacggggggatgctgaaacctcaacgtggaggccggcaaggagggccggaagatggactacctcttctccgacctcgtcgacccctacctcgctgtcgactttacgcgcttcgcccacgctgacagcgtcgtgcccagcggcgtcgccaccggcgccgtacccgccgtcgtggacctggacttcgcgtgcgggatcggcgccaagccgccggcgacctacagctcctcgtacacggccaacgcctccggcgcgcacagcggctcttcatcggaggtcagcgtggtgccggaggccatctgcggcggcgtcgggagcttcgagatcgacttcacccggcccaagccgcagccgtacatgcccgcgtacaccgcggcaccgccgagccatggggtgagcgcgcagcaggcgtggccggtggacatggggtacttgacggtgccggagcgtccggtggcggtgaccggggagggcagggtggcgaggctgatgcggtaccgggagaagaggaagaaccgccggttcgagaagaccatccggtacgcgtccaggaaggcctacgccgagtcgcggccgcgcgtcaagggccgcttcgccaagcgcaccgaccaggacgccgacggcgacgacgtggacgcggaggcccatgccgtgccgtcttccacgtcctacttgctcgactttggctacggcgtcgtgccgtccttctgatccgccggcccggcgccccggccggcggccttgtacttgtaccattgatgcatgtacagtagtacgtaggggactagtaatccatccatgtactcctcctgagctagttcgatcgcgcttttgatgtactagtaatactgtaaactgtaacagtagtagtactttggccaatatgctcgtttatttttggatggccgaaactagtagcccaaacatttggatcatcaatcattatt

SEQ ID NO: 36 - protein, 372 aa, Triticum aestivum
  misc_feature: Ceres CLONE ID no.702632
  misc_feature: Bit score of 497.8 for hmm based on sequences of FIGURE 2.
  misc_feature (295)..(339): Pfam Name: CCT Pfam Description: CCT motif
  misc_feature (51)..(98): Pfam Name: zf-B_box Pfam Description: B-box zinc finger
  misc_feature: Functional Homolog Of Ceres SEEDLINE ID no. ME04315 at SEQ ID NO. 20
MMELRKYWGVGGRRCGACEGAAPAAVHCRDCAGYLCTGCDARPAHARAGHERVWVCEVCEVSPAAVTCKADAAVLCAVCDADIHHANPLAERHVRVPIAPICSPEAAAVAAEAMMFCGAGDGEARADQDDVPEQLHQHGGMLNLNVEAGKEGRKMDYLFSDLVDPYLAVDFTRFAHADSVVPSGVATGAVPAVVDLDFACGIGAKPPATYSSSYTANASGAHSGSSSEVSVVPEAICGGVGSFEIDFTRPKPQPYMPAYTAAPPSHGVSAQQAWPVDMGYLTVPERPVAVTGEGRVARLMRYREKRKNRRFEKTIRYASRKAYAESRPRVKGRFAKRTDQDADGDDVDAEAHAVPSSTSYLLDFGYGVVPSF

SEQ ID NO: 37 - DNA, 1345 bp, Zea mays
  misc_feature: Ceres CLONE ID no.1559496
  misc_feature: Encodes the peptide sequence at SEQ ID NO 38
ctgacacccgtggcatccctctcgtgactcccggagcggaggcatggacaccgcggcggagctggagctggggctggagttggagcagaagccggcggcggggtactggagcgtggtgggcgcgcgcccttgcgacgcgtgcgccgcggagccggcgcggctgcactgccgcgcggacggcgcgttcctgtgccccggctgcgacgcccgggcgcacggcgccgggtcgcgccacgcgcgcgtctggctgtgcgaggtctgcgagcacgcccccgccgtcgtcacctgccgcgccgacgccgccgcgctctgcgccgcctgcgacgccgacatccactcggccaacccgctcgcgcgccgccacgagcgcctccccatcgcccctctcttcggcgcgctcgcggacgcgccgcagcccttcccgtccccggccctcgctgccgccgcgggggccgaggccccggccccgaccccggctcagggtgaagcggtggcggaagactacgggagcagcgaggccgaggcggcgtcgtggttgctccccgagcccgacaacagccacgaggacagcgccgccgacacgttcttcgcggagtcggacgcgtacctcggcgccgacctcgacttcgcccggtgcatggacggcgtcaaggccatcggcgtgccggtcgcgccgcccgagctggacatcggtgccggcagcttttgctaccccgaacactccatgaaccacattttgtcgtcatcctcggaggtggcggtggtaccggacgcgcaggcggccggtctgccggtggtggtggtggtgagcagaggggaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgccgttccgcggagggcgaggacgaggcgctggagcacgaggaaggggcgtgcttctcgcccgcggggtcggcgcccgccgcgtcggacggcgtcgtcccgtccttgtgttgaggggagaagacgacgacgaccccggcagacggctgcttaactttgccagctctgtcgaccctgaaccttttttttttccctcccccaccttctctcttttgatcgaggggttgccagctctggatctgaaactctgaacgcatgggacgcgagctgtgtgtagcatgaataactgcgtagtttgttggatggacgaactcaatcgcgctcgcatggaatggaactcttgtaatccaccctttgtacattaccatctagagttgctccttttttccatgagcc

SEQ ID NO: 38 - protein, 339 aa, Zea mays
  misc_feature: Ceres CLONE ID no.1559496
  misc_feature: Bit score of 612.0 for hmm based on sequences of FIGURE 2.
  misc_feature (261)..(305): Pfam Name: CCT Pfam Description: CCT motif
  misc_feature (70)..(112): Pfam Name: zf-B_box Pfam Description: B-box zinc finger
  misc_feature: Functional Homolog Of Ceres SEEDLINE ID no. ME04315 at SEQ ID NO. 20
MDTAAELELGLELEQKPAAGYWSVVGARPCDACAAEPARLHCRADGAFLCPGCDARAHGAGSRHARVWLCEVCEHAPAVVTCRADAAALCAACDADIHSANPLARRHERLPIAPLFGALADAPQPFPSPALAAAAGAEAPAPTPAQGEAVAEDYGSSEAEAASWLLPEPDNSHEDSAADTFFAESDAYLGADLDFARCMDGVKAIGVPVAPPELDIGAGSFCYPEHSMNHILSSSSEVAVVPDAQAAGLPVVVVVSRGEEREARLMRYREKRKNRRFDKTIRYASRKAYAETRPRIKGRFAKRRSAEGEDEALEHEEGACFSPAGSAPAASDGVVPSLC

SEQ ID NO: 39 - DNA, 1490 bp, Zea mays
  misc_feature: Ceres CLONE ID no.1674443
  misc_feature: Encodes the peptide sequence at SEQ ID NO 40
gctgcgctgcctccctccactactacgccagccactctgccttccctcccccaccaccacaagaaccgcttcaccattgccgcgccgcgtccagctgagcctcctcttagccgcgccagccaggagaaggcgcgcgcgcacacctgctgcttggtgaccgcgttcgatggagctgcacaagtactggggcgtggggggccggcggtgcggcagctgcgagggggccccggcggcggtgcactgccgcacgtgcgttggtggatccttcctctgcacgacgtgcgacgcccgccccgcgcacgcgcgcctgggccacgagcgcgtgtggatgtgcgaggtctgcgagctggcccccgccgccgtcacgtgcaaggccgacgccgccgtgctctgcgccgcttgcgactccgacatccacgacgccaacccgctggcccggcgccacgcgcgggtccccgtcgcccccatcggctccgaggccgccgccgcggccgtggaggccatgctgttcgggaccggcgaggcggccgcttccgaggccgacgagcagcacgcggcggccgagcacgcgcacgcgcacgcgctgaacctcaacgtggaggccaaggacatgaagctggactacctcttctctgaactggatccctacctcagcgtcgagatcccgcgcttccagcacgctgacagcgtcgtccccaacggcgccggcgctgccgtcgagctggacttcacgtgcggcatcggcgttaagcactcctcctacagctcctacacggccacctccctcgctcatagcggctcctcgtcggaggttggcgtggtgccagaggccttcggcggcagcggcagcggcggcgggagctttgagctcgacttcacaaggcccaagcctcaggcctacatgccatacaccgggactccccagagccacagcgtgccatccgcggacgtggaggtggtgccggagcggggagacttggctgcggtgaggccggtgccgctgatgggggagagcagggaggcgcgcctgatgcggtaccgtgagaaaaggaagaacaggcgcttcgagaagaccatccggtacgcgtcccggaaggcctacgccgagacgcggccgcgaatcaagggccggtttgccaagcgtgctgaccacgacggggacgccgacgccgacgacgctgaggccgaggccgaggccgaggccgccgtgccgatgtcatatgtgctcgacttcggctacggcgtcgtaccgagcttttgatgtgcccgggcccaacacgcgcgcacatggccggccgcgcgcttgaaccggcatggcacgccgctgcgcgcgcgccttgtacttgtatcgatcgatgtatagggaggagtagtaatcccatgtactctctttttgagcaagctcttgcgtaaactagtgatgtataatttgtactactagtaagaaactgcagtagccgctgctaatggatcaccaatctataccgcgc

SEQ ID NO: 40 - protein, 364 aa, Zea mays
  misc_feature: Ceres CLONE ID no.1674443
  misc_feature: Bit score of 815.7 for hmm based on sequences of FIGURE 2.
  misc_feature (284)..(328): Pfam Name: CCT Pfam Description: CCT motif
  misc_feature (51)..(98): Pfam Name: zf-B_box Pfam Description: B-box zinc finger
  misc_feature: Functional Homolog Of Ceres SEEDLINE ID no. ME04315 at SEQ ID NO. 20
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEHAHAHALNLNVEAKDMKLDYLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSADVEVVPERGDLAAVRPVPLMGESREARLMRYREKRKNRRFEKTIRYASRKAYAETRPRIKGRFAKRADHDGDADADDAEAEAEAEAAVPMSYVLDFGYGVVPSF

SEQ ID NO: 41 - DNA, 1449 bp, Panicum virgatum
  misc_feature: Ceres CLONE ID no.1828897
  misc_feature: Encodes the peptide sequence at SEQ ID NO 42
gcgcgcgctccctcccctcccctcctcccaccagcccaccaccaccacaagcaccgcgtcgtccacaccacctgccattgccgcgccgagctcagcctctagctgcgccaggagggcgcccgcctccctccctgccgacgccggtgtgatggagctgcacaagtactggggcgtggggggccgccggtgcggcggctgcgaggcggccccggcggcggtgcactgccgctcgtgccccgccgggggcgcgttcctctgcacggcgtgcgacgcgcgcccggggcacgcgcatctgggccacgagcgcgtgtggatgtgcgaggtctgcgagctggcgcccgccgccgtcacgtgcaaggccgacgccgccgtgctctgcgccgcctgcgacgccgacatccacgacgccaacccgctggcgcgccgccacgcacgcgtccccgtcgcgcccatcggctcggaggccgcggccgccgccgtggaggccatgctgttcgggaccggcgagccggccgcgtccgaggccgaggagccgcagaacgcggcggccgggcacaaccaccagcacgcgctgaacctcaacgtggaggccaaggacatgaagctggactacctcttttccgacctggacccctacctcagcgtcgatatcccgcgcttccagcacgccgacagcgtcgtccccagcggcgtcggcgccggagcagccggcgccgtcgagctggacttcacgtgcggcatcggcgtcgagccctccgggggggggggggggggggggacatccctcgcccacagcggctcctcttctgaggtcggcgtggtgccagaggccttctgcggcgggggggggagcttcgagctcgacttcacaaggcccaagcctcaagcctacatgccgtacaccgcgactcctcagagtcacagcgtgtcgtcggtggacgtggaggtggtgccggagcggggggacatgatggcggcggcgaggccggtgccgctggtgggggagagccgggaggcgcggctgatgcgctaccgggagaagcggaagaaccggcggttcgagaagaccatccggtacgcgtcccggaaggcctacgccgagatgcggccgcggatcaagggccggttcgccaagcgcgccgaccacgacgccgacgccgacgacgccgaggccgaggccgaggccgccgtgccgtcgccggcgtcgtacgtgctcgacttcggctacggcgtcgtgcccagcttctgatcgacgacgatcgtctcgctcgttccacgcgcggcgcgcttgacccggcaccggcgcgcgcgccttgtacttgtatcgatgcatgtataggggaggaatagtaatcccatgtactctcgtcttggagctgcgctagccctgcgtacgtacgctagtgatgtataatttgtacaacccagtattttgccctgtacccgctc

SEQ ID NO: 42 - protein, 366 aa, Panicum virgatum
  misc_feature: Ceres CLONE ID no.1828897
  misc_feature: Bit score of 667.9 for hmm based on sequences of FIGURE 2.
  misc_feature (288)..(332): Pfam Name: CCT Pfam Description: CCT motif
  misc_feature (52)..(99): Pfam Name: zf-B_box Pfam Description: B-box zinc finger
  misc_feature: Functional Homolog Of Ceres SEEDLINE ID no. ME04315 at SEQ ID NO. 20
MELHKYWGVGGRRCGGCEAAPAAVHCRSCPAGGAFLCTACDARPGHAHLGHERVWMCEVCELAPAAVTCKADAAVLCAACDADIHDANPLARRHARVPVAPIGSEAAAAAVEAMLFGTGEPAASEAEEPQNAAAGHNHQHALNLNVEAKDMKLDYLFSDLDPYLSVDIPRFQHADSVVPSGVGAGAAGAVELDFTCGIGVEPSGGGGGGGTSLAHSGSSSEVGVVPEAFCGGGGSFELDFTRPKPQAYMPYTATPQSHSVSSVDVEVVPERGDMMAAARPVPLVGESREARLMRYREKRKNRRFEKTIRYASRKAYAEMRPRIKGRFAKRADHDADADDAEAEAEAAVPSPASYVLDFGYGVVPSF

SEQ ID NO: 43 - protein, 332 aa, Oryza sativa subsp. indica
  misc_feature: Public GI ID no.125540249
  misc_feature: Bit score of 624.0 for hmm based on sequences of FIGURE 2.
  misc_feature (261)..(305): Pfam Name: CCT Pfam Description: CCT motif
  misc_feature (72)..(114): Pfam Name: zf-B_box Pfam Description: B-box zinc finger
  misc_feature: Functional Homolog Of Ceres SEEDLINE ID no. ME04315 at SEQ ID NO. 20
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFTFSQAAADAAGAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGAAAPPMVVVVASKGKEREARLMRYREKRKNRRFDKTIRYASRKAYAETRPRIKGRFAKRTADADDDDEAPCSPAFSALAASDGVVPSF

SEQ ID NO: 44 - protein, 331 aa, Oryza sativa subsp. indica
  misc_feature: Public GI ID no.116310719
  misc_feature: Bit score of 733.5 for hmm based on sequences of FIGURE 2.
  misc_feature (239)..(283): Pfam Name: CCT Pfam Description: CCT motif
  misc_feature (62)..(104): Pfam Name: zf-B_box Pfam Description: B-box zinc finger
  misc_feature: Functional Homolog Of Ceres SEEDLINE ID no. ME04315 at SEQ ID NO. 20
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADGEDEEMYSSAAAAVAALMAPGGSDADYGVDGVVPTF

SEQ ID NO: 45 - protein, 370 aa, Oryza sativa subsp. indica
  misc_feature: Public GI ID no.125556324
  misc_feature: Bit score of 608.3 for hmm based on sequences of FIGURE 2.
  misc_feature (294)..(338): Pfam Name: CCT Pfam Description: CCT motif
  misc_feature (50)..(97): Pfam Name: zf-B_box Pfam Description: B-box zinc finger
  misc_feature: Functional Homolog Of Ceres SEEDLINE ID no. ME04315 at SEQ ID NO. 20
MELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEEKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 46 - protein, 347 aa, Oryza sativa subsp. indica
  misc_feature: Public GI ID no.125538317
  misc_feature: Bit score of 444.3 for hmm based on sequences of FIGURE 2.
  misc_feature (279)..(323): Pfam Name: CCT Pfam Description: CCT motif
  misc_feature (55)..(102): Pfam Name: zf-B_box Pfam Description: B-box zinc finger
  misc_feature: Functional Homolog Of Ceres SEEDLINE ID no. ME04315 at SEQ ID NO. 20
MELGLGRYWGVGGRRCGACAVAPAAVHCRTCDGGGGGGGYLCAGCDAEHGRAGHERVWVCEVCELAPAAVTCKADAAALCAACDSDIHDANPLARRHERVPGHPIGSSAAPPPDALLLGGENDAAAAVDGGGGGKEVKLDFLFADFMDPYLGGSPELARFPHADSVVPNHNGSAGPAMELGFAGGGGAAVKPSYSSYTAASLGNSGSSSEVGLVPDAICGGGGGGIIELDFAQSKAAYLPYASTPSHSMSSSMDMGVAAPEMSDGAAAAAGRAYAAEGRAARLMRYREKRKNRRFEKTIRYASRKAYAETRPRVKGRFAKRADDHDAAAPPPQIMLDFAGYGVVPTF

SEQ ID NO: 47 - protein, 332 aa, Oryza sativa subsp. japonica
  misc_feature: Public GI ID no.115447239
  misc_feature: Bit score of 623.8 for hmm based on sequences of FIGURE 2.
  misc_feature (261)..(305): Pfam Name: CCT Pfam Description: CCT motif
  misc_feature (72)..(114): Pfam Name: zf-B_box Pfam Description: B-box zinc finger
  misc_feature: Functional Homolog Of Ceres SEEDLINE ID no. ME04315 at SEQ ID NO. 20
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 48 - protein, 333 aa, Oryza sativa subsp. japonica
  misc_feature: Public GI ID no.115459216
  misc_feature: Bit score of 726.7 for hmm based on sequences of FIGURE 2.
  misc_feature (239)..(283): Pfam Name: CCT Pfam Description: CCT motif
  misc_feature (62)..(104): Pfam Name: zf-B_box Pfam Description: B-box zinc finger
  misc_feature: Functional Homolog Of Ceres SEEDLINE ID no. ME04315 at SEQ ID NO. 20
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGAHGGDAAAADDDGSNDAEAASWLLPEPDHGQKDGAVGATDELYADSDPYLDLDFARSMDDIKAIGVQNGPPELDITGGKLFYSDHSMNHSVSSSEAAVVPDAAAGGGAPMPVVSRGREREARLMRYREKRKSRRFEKTIRYASRKAYAETRPRIKGRFAKRTKGGAGADADADADADGEDEEMYSSAAAAVAALMAPGGSDADYGVDGVVPTF

SEQ ID NO: 49 - protein, 370 aa, Oryza sativa subsp. japonica
  misc_feature: Public GI ID no.115469296
  misc_feature: Bit score of 607.4 for hmm based on sequences of FIGURE 2.
  misc_feature (294)..(338): Pfam Name: CCT Pfam Description: CCT motif
  misc_feature (50)..(97): Pfam Name: zf-B_box Pfam Description: B-box zinc finger
  misc_feature: Functional Homolog Of Ceres SEEDLINE ID no. ME04315 at SEQ ID NO. 20
MELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEDKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 50 - protein, 332 aa, Oryza sativa subsp. japonica
  misc_feature: Public GI ID no.125582846
  misc_feature: Bit score of 505.9 for hmm based on sequences of FIGURE 2.
  misc_feature (261)..(305): Pfam Name: CCT Pfam Description: CCT motif
  misc_feature (27)..(71): Pfam Name: zf-B_box Pfam Description: B-box zinc finger
  misc_feature: Functional Homolog Of Ceres SEEDLINE ID no. ME04315 at SEQ ID NO. 20
MEAVEDKAMVGVGGAVAAGYSSSSWGLGTRACDSCGGEAARLYCRADGAFLCARCDARAHGAGSRHARVWLCEVCEHAPARRHVPGGRRGAVRRLRRRHHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 51 - protein, 375 aa, Medicago truncatula
  misc_feature: Public GI ID no.92875402
  misc_feature: Bit score of 812.8 for hmm based on sequences of FIGURE 2.
  misc_feature (298)..(342): Pfam Name: CCT Pfam Description: CCT motif
  misc_feature (60)..(107): Pfam Name: zf-B_box Pfam Description: B-box zinc finger
  misc_feature: Functional Homolog Of Ceres SEEDLINE ID no. ME04315 at SEQ ID NO. 20
MGIERGGLKSLRGGWSVPPKLCDSCKLTPAALFCRSDSAFLCINCDSTIHSANKLSSRHERVWMCEVCEQAPASVTCKADAAALCVTCDSDIHSANPLARRHERVPVEPFFDSAESVVKSSSAAAAAAASFNFVVPTDDGYGQDDAEAAAWLIPNPNFGSKLNETQDIKTREMFFSDMDPFLDFDYSNNFQNNNCSNAMNDSVVPVQTKPTPAPMMNHNSEGCFDIDFCRSKLSSFNYPSHSISHSVSSSSLDVGVVPDGNTVSEISYNFGSESMVSGGVNSSNQGVQGATQLCGMDREARVMRYREKRKNRKFEKTIRYASRKAYAETRPRIKGRFAKRTEIDSDVDRLYNPADPLSVPSSMLMDCPYGVVPTF

SEQ ID NO: 52 - protein, 307 aa, Raphanus sativus
  misc_feature: Public GI ID no.3341723
  misc_feature: Bit score of 395.2 for hmm based on sequences of FIGURE 2.
  misc_feature (1)..(48): Pfam Name: zf-B_box Pfam Description: B-box zinc finger
  misc_feature (241)..(285): Pfam Name: CCT Pfam Description: CCT motif
  misc_feature: Functional Homolog Of Ceres SEEDLINE ID no. ME04315 at SEQ ID NO. 20
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 53 - protein, 329 aa, Malus x domestica
  misc_feature: Public GI ID no.4091806
  misc_feature: Bit score of 506.4 for hmm based on sequences of FIGURE 2.
  misc_feature (1)..(48): Pfam Name: zf-B_box Pfam Description: B-box zinc finger
  misc_feature (268)..(312): Pfam Name: CCT Pfam Description: CCT motif
  misc_feature: Functional Homolog Of Ceres SEEDLINE ID no. ME04315 at SEQ ID NO. 20
MASKLCDSCQSATATLFCRADSAFLCVNCDSKIHAANKLASRHPRVWLCEVCEQAPAHVTCKADDAALCVTCDRDIHSANPLSSRHDRVPVTPFYDSVNSAANSVPVVKSVVNFLDDRYLSDVDGETEVSREEAEAASWLLPNPKAMENPDLNSGQYLFQEMDPYLDLDYGHVDPKLEEAQEQNSCGADGVVPVQSKNMQPLLVNDQSFELDFSAGSKPFVYGYHHARCLSQSVSSSSMDISVVPDGNAVTAAVETSQPAVQLSSVDRVARVLRYREKRKNRKFEKTIRYASRKAYAETRPRIKGRFAKRTEVEIEAERMCRYGVVPSF

SEQ ID NO: 54 - protein, 312 aa, Pisum sativum
  misc_feature: Public GI ID no.60459257
  misc_feature: Bit score of 400.3 for hmm based on sequences of FIGURE 2.
  misc_feature (1)..(48): Pfam Name: zf-B_box Pfam Description: B-box zinc finger
  misc_feature (245)..(289): Pfam Name: CCT Pfam Description: CCT motif
  misc_feature: Functional Homolog Of Ceres SEEDLINE ID no. ME04315 at SEQ ID NO. 20
MATKLCDSCKSTKATLFCRSDSAFLCITCDSNIQAANKLASRHHRVTLCEVCEQAPAHVTCKADAAALCVSCDHDIHSANPPASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSSSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 55 - DNA, 1283 bp, Panicum virgatum
  misc_feature: Ceres CLONE ID no.1756710
  misc_feature: Encodes the peptide sequence at SEQ ID NO 56
agcagccactacaagctgccgtgccgagtgagctagtgagcgagcgagctcccggcgcgcgatggagggtgacaagaagtcggcgggcggggccccggcctactggggcctgggcgcgcggccctgcgacgagtgcggcgccgaggcggcgcggctctactgccgcgcggacgcggcgttcctctgcgccgggtgcgacgcgcgcgcgcacggcgccgggtcgcgccacgcccgcgtctggctgtgcgaggtctgcgagcacgcgccggccgccgtcacgtgccgcgcggacgccgccgcgctctgcgcctcctgcgacgccgacatccactccgccaacccgctcgcgcgccgccacgagcgccagaccgtggcgcccttctacggcgcgctcgccgacgcgcccaagcccttcgcctcgtcggtggccgtgcccaaagcggccgacgacgacggaagcaacgaggccgaggcggcgtcgtggctcctccccgagcccgaccacgggcacaaggaaggcgccacgacggaggtgttcttcgcggactccgacccgtacctcgacctcgacttcgcgcgcaccatggacgacatcaaggccatcggcgcccagaacggccccgccggcgccgagctcgacctcaccggcgccaagctcttctactccgaccactccatgaactacagcgtgtcgtcgtcggaggcagcggtggtgcccgacgcggcggcgggcgcggcgcccgtcgtgcctgtggtgagcaggggcctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcaccccggggcccggcgcggacggggaggacccgctggaggagcacgaggaggagatgtactcctccgccgcggccgccgtggccgcgctcatggcccccggcggcgccgacgccgactacggcgtcgtgcccacgtattgatcggcgccggcctgctgtacactagctagcctcgacctctcggggctgtaatttttgctgcatgccttgcatgcaaaaagctgccgtgtagcattgattacctgtaatatgattccacggaagccatgaggctggacttccaagctcttcttcctccctaatgattccgtcatgtacggatgtatattattattatttatcacgaactgctgctaatctgcaactgtaatttctaattagc

SEQ ID NO: 56 - protein, 326 aa, Panicum virgatum
  misc_feature: Ceres CLONE ID no.1756710
  misc_feature: Bit score of 628.3 for hmm based on sequences of FIGURE 2.
  misc_feature (238)..(282): Pfam Name: CCT Pfam Description: CCT motif
  misc_feature (62)..(104): Pfam Name: zf-B_box Pfam Description: B-box zinc finger
  misc_feature: Functional Homolog Of Ceres SEEDLINE ID no. ME04315 at SEQ ID NO. 20
MEGDKKSAGGAPAYWGLGARPCDECGAEAARLYCRADAAFLCAGCDARAHGAGSRHARVWLCEVCEHAPAAVTCRADAAALCASCDADIHSANPLARRHERQTVAPFYGALADAPKPFASSVAVPKAADDDGSNEAEAASWLLPEPDHGHKEGATTEVFFADSDPYLDLDFARTMDDIKAIGAQNGPAGAELDLTGAKLFYSDHSMNYSVSSSEAAVVPDAAAGAAPVVPVVSRGLEREARLMRYREKRKSRRFEKTIRYASRKAYAETRPRIKGRFAKRTPGPGADGEDPLEEHEEEMYSSAAAAVAALMAPGGADADYGVVPTY

SEQ ID NO: 57 - DNA, 1398 bp, Triticum aestivum
  misc_feature: Ceres CLONE ID no.907473
  misc_feature: Encodes the peptide sequence at SEQ ID NO 58
gtttttaactcgacttagccaagtttggcaaacgaacaggccccgtggccccgcccccgcgcgacagcgaccgggcgcccgaagtgtctcgcgctcgcccacggcacccgagcggagcccccgcccctaccatgtgctctccctgcccgcagacccctcaaaacccacccgcgcccgcacccaggcaccgagcacccagcagaaagaaacgcaccaaatctttatcccctgccctcagcagtgccgacctgagcgccggagatctgcggcgagcgagatgaaagtggaggagcagacggtggtgggaggaggaggaggggggctctgggggctggccgggcggccgtgcgacacgtgcgccgtggacgcggcgcggctctactgccggtcggacggcgcctacctctgcgccgggtgcgacgcgcgcgctcacggggccggctcccgccacgcgcgcgtctggctctgcgaggtctgcgagcacgcgcccgccgcggtcacctgccgcgccgacgccgccgcgctctgcgccacgtgcgacgccgacatccactccgccaacccgctcgccagccggcacgagcgcctccccgtcacgcctttcttcggcgcgctcgccgacccgccccagcccgccccctccccgtcctccgccgccgcgacgcaggaggacgcggacgacgacgggagcaacgaggccgaggcggcctcctggcttcttcccgagcctggcgatagccccgaggacagcaccgctaccttcttccctgactcggacgcgtacctcgatctggacttcgtccggtctatggacgggatcaaggccatcggggtgcccgtcgccccttccgagctcgacgtcgccggcggcgctctcttctaccccgaacactccatgaaccacagcatgtcaacgtccgaggtcgcggtggtgccggacgcgctgtcagccggcggggccccggcgccggcgccgtcggtggcggtggtggctagcaaggggaaggagcgggaggcccggctgatgcggtaccgggagaagcgcaagaaccggaggttccagaagaccatccgctacgcgtcccgcaaggcgtacgccgagacgcggccgcgcatcaagggccggttcgccaagcgcaccgccgaggacgacgcgctggagcgggacgggccgttctcgcccgcgtcgtcggcgcacctggcgtcggacggtgactacggcgtcgtgccgtccttctgaggagaccggcgacggcgacggcgactctgctgtagttttggcgcgcgcatccatccgagtgcgctcgcgtgcggtggctgcgacgcgcgctccgtgtaacattgaataatctgtacagttttgttccatgggattagtgccgtgaccgtgccgacctg

SEQ ID NO: 58 - protein, 320 aa, Triticum aestivum
  misc_feature: Ceres CLONE ID no.907473
  misc_feature: Bit score of 719.5 for hmm based on sequences of FIGURE 2.
  misc_feature (245)..(289): Pfam Name: CCT Pfam Description: CCT motif
  misc_feature (64)..(106): Pfam Name: zf-B_box Pfam Description: B-box zinc finger
  misc_feature: Functional Homolog Of Ceres SEEDLINE ID no. ME04315 at SEQ ID NO. 20
MKVEEQTVVGGGGGGLWGLAGRPCDTCAVDAARLYCRSDGAYLCAGCDARAHGAGSRHARVWLCEVCEHAPAAVTCRADAAALCATCDADIHSANPLASRHERLPVTPFFGALADPPQPAPSPSSAAATQEDADDDGSNEAEAASWLLPEPGDSPEDSTATFFPDSDAYLDLDFVRSMDGIKAIGVPVAPSELDVAGGALFYPEHSMNHSMSTSEVAVVPDALSAGGAPAPAPSVAVVASKGKEREARLMRYREKRKNRRFQKTIRYASRKAYAETRPRIKGRFAKRTAEDDALERDGPFSPASSAHLASDGDYGVVPSF

SEQ ID NO: 59 - protein, 340 aa, Malus x domestica
  misc_feature: Public GI ID no.4091804
  misc_feature: Bit score of 486.8 for hmm based on sequences of FIGURE 2.
  misc_feature (1)..(48): Pfam Name: zf-B_box Pfam Description: B-box zinc finger
  misc_feature (279)..(323): Pfam Name: CCT Pfam Description: CCT motif
  misc_feature: Functional Homolog Of Ceres SEEDLINE ID no. ME04315 at SEQ ID NO. 20
MALKLCDSCKSATGTLFCRADSAFLCVNCDSKIHAANKLASRHARVWLCEVCEQAPAHVTCKADDAALCVTCDRDIHSANPLSHADERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 60 - protein, 323 aa, Hordeum vulgare subsp. vulgare
  misc_feature: Public GI ID no.21667487
  misc_feature: Bit score of 599.5 for hmm based on sequences of FIGURE 2.
  misc_feature (236)..(280): Pfam Name: CCT Pfam Description: CCT motif
  misc_feature (61)..(103): Pfam Name: zf-B_box Pfam Description: B-box zinc finger
  misc_feature: Functional Homolog Of Ceres SEEDLINE ID no. ME04315 at SEQ ID NO. 20
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 61 - protein, 325 aa, Hordeum vulgare subsp. vulgare
  misc_feature: Public GI ID no.21655154
  misc_feature: Bit score of 678.1 for hmm based on sequences of FIGURE 2.
  misc_feature (250)..(294): Pfam Name: CCT Pfam Description: CCT motif
  misc_feature (70)..(112): Pfam Name: zf-B_box Pfam Description: B-box zinc finger
  misc_feature: Functional Homolog Of Ceres SEEDLINE ID no. ME04315 at SEQ ID NO. 20
MKVEEQTVVGGGGGAGQGGAGFWGLAGRPCDTCAVDAARLYCRLDGAYLCAGCDARAHGAGSRHARVWLCEVCEHAPAAVTCRADAAALCATCDADIHSANPLASRHLLLPTPFFGALADPPQPVPSPSSAAATQEDAEDDGSNEAEAASWLLPEPGDSPEDSAATFFADSDAYLDLDFVRSMDGIKAIGVPVAPSELDLAGGTLFYPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 62 - protein, 391 aa, Solanum lycopersicum
  misc_feature: Public GI ID no.45544883
  misc_feature: Bit score of 432.4 for hmm based on sequences of FIGURE 2.
  misc_feature (322)..(366): Pfam Name: CCT Pfam Description: CCT motif
  misc_feature (52)..(99): Pfam Name: zf-B_box Pfam Description: B-box zinc finger
  misc_feature: Functional Homolog Of Ceres SEEDLINE ID no. ME04315 at SEQ ID NO. 20
MLKKENSNNWARVCDSCHSATCTVYCRADSAYLCAGCDARIHTASLMASRHERVWVCEACERAPAAFLCKADAASLCASCDADIHSANPLARRHHRVPIMPIPGTIYGPPAVHTITGGSMMIGGTTGEGTEDDGFLSLNQDADDTTIDEEDEDEAASWLLLNPPVKNNNKNNNYGMLFGGEVVDDYLDLAEYGGDSQFNDQYSVNQQQQHYSVPQKSYVEDSVVPVQNGQRKSLILYQTPQQQQSHHLNFQLGMEYDNSNTGYGYPASLSHSVSISSMDVSVVPESAQSETSNSHPRPPKGTIDLFSGPPIQIPPQLTPMDREARVLRYREKKKNRKFEKTIRYASRKAYAETRPRIKGRFAKRTDVEAEVDQMFSTQLMTDSNYGIVPSF

SEQ ID NO: 63 - protein, 376 aa, Hordeum vulgare subsp. vulgare
  misc_feature: Public GI ID no.21655166
  misc_feature: Bit score of 528.8 for hmm based on sequences of FIGURE 2.
  misc_feature (297)..(341): Pfam Name: CCT Pfam Description: CCT motif
  misc_feature (51)..(98): Pfam Name: zf-B_box Pfam Description: B-box zinc finger
  misc_feature: Functional Homolog Of Ceres SEEDLINE ID no. ME04315 at SEQ ID NO. 20
MMELRKYWGVGGRRCGGCEGAAPAAVHCRDCAGYLCTGCDARPAHARAGHERVWVCEVCEVSPAAVTCKADAAVLCAACDADIHHANPLAERHVRVPIAPIGSPEAAAVAAEAMMLCGAGDGDARADPDEVHDQLHHHGHGGMLNLNVEAGKEGGKMDYLFSDLVDPYLAVDFTRFAHADSVVPNGVATAAVPAVVDLDFACGIGAKPPPSYSSSYTANGSGAHSGSSSEVGVVPEAIHGGAGSFELDFTRPKPQAYMPAYTPAPPSHGVGMQQASAVDMGYLTVPERPVAVTGEGRVARLMRYREKRKNRRFEKTIRYASRKAYAESRPRVKGRFAKRADQDADGDGDDLDAEAHAVPSSTSYLLDFGYGVVPSF

SEQ ID NO: 64 - protein, 417 aa, Ipomoea nil
  misc_feature: Public GI ID no.10946337
  misc_feature: Bit score of 351.2 for hmm based on sequences of FIGURE 2.
  misc_feature (348)..(392): Pfam Name: CCT Pfam Description: CCT motif
  misc_feature (77)..(119): Pfam Name: zf-B_box Pfam Description: B-box zinc finger
  misc_feature: Functional Homolog Of Ceres SEEDLINE ID no. ME04315 at SEQ ID NO. 20
MLKEESCEVLDLDVTIGSSSGSRSGNKQNWARVCDICRSAACSVYCRADLAYLCGGCDARVHGANTVAGRHERVLVCEACESAPATVICKADAASLCAACDSDIHSANPLARRHHRVPILPISGTLYGPPTSNPCRESSMMVGLTGDAAEEDNGFLTQDAEETTMDEDEDEAASWLLLNPNPNPNPNPVKSNNSTNMCKGGNNNNNEMSCAVEAVDAYLDLAEFSSCHNNLFEDKYSINQQQNYSVPQRNMSYRGDSIVPNHGKNQFHYTQGLQQHNHHAIFNCKEWNMRILTRDMVSISSMDVGVVPESTLSDTSISHSRASKGTIDLFSGPPIQMPPQLQLSQMDREARVLRYREKKKTRKFEKTIRYASRKAYAETRPRIKGRFAKRTDVDTEVDQIFYAPLMAESGYGIVPSF

SEQ ID NO: 65 - protein, 381 aa, Cleome spinosa
  misc_feature: Public GI ID no.90657642
  misc_feature: Bit score of 456.0 for hmm based on sequences of FIGURE 2.
  misc_feature (312)..(356): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME04315 at SEQ ID NO. 20
MLKEERTSGGETGENNWARICDTCRSAACTVYCRADSAYLCTSCDARVHAANHVASRHERVWVCESCERAPAAFLCKADAASLCAACDAEIHSANPLARRHHRVPILPISGSMSGPMANHHPSETAMTDTENDMVVGREEAEDEDEDDEEAASWLLLNPGKNSGNNNNQNNGFFFDGEADEYLDLVEYNSSMENQFSDQYSQYHQDCGVPQKSFGGDGVVPLQVEESRGQLHHEQQSFQLAITYGSPGALYGSYNGSMNHSVSMSSMDIVVVPESTASDMAVVSQLRAPKGTTDLLIGPPIQMMPQLSPMDREARVLRYREKKKTRKFEKTIRYASRKAYAETRPRIKGRFAKRTDIEAEVDQAFSTTLMQESGYGIVPSF

SEQ ID NO: 66 - DNA, 155 bp, Hordeum vulgare subsp. vulgare
  misc_feature: 000HORDEUM
  misc_feature: Homolog Of Ceres SEEDLINE ID no. ME00572 at SEQ ID NO. 111
tcctcgtgtcagaattaacgttcttgaccttgtaaggccttttcttgaccttgtaaggccctcccctaacgtttctcctggtgtctccaacctcacactttctttcccctttctatccctcctgagctattccctattttgtacgtctacaatct

SEQ ID NO: 67 - DNA, 161 bp, Picea sp.
  misc_feature: 000PICEA
  misc_feature: Homolog Of Ceres SEEDLINE ID no. ME00572 at SEQ ID NO. 111
atcaccccaaactgagcctttcttgaccttgtaagaccttttcttgaccttgtaagaccagccatagaatcccgagaacaaggtcgctcaactctcaaacaatcttcttctaattagtctatccctcctgagctatttacagttgagtttcaagttcttcc

SEQ ID NO: 68 - protein, 409 aa, Solanum lycopersicum
  misc_feature: Public GI ID no.45544887
  misc_feature: Bit score of 383.3 for hmm based on sequences of FIGURE 2.
  misc_feature (340)..(384): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME04315 at SEQ ID NO. 20
MLKKENSGGLDGSSNYWARVCDSCRSVTCTIYCQADSAYLCADCDARIHAASLVTSRHKRVWVCEACERAPAAFLCKADAASLCASCDADIHSANPLAHRHHRIPIITIPGTLYGPPAVETVGGDSMMISGSTGEGTEDDGFLSLTQDADDTIIDEEDEDEDEAASWLLLNHPVKNNNKNNVNNNNNQTNNYDMLFGGEVVDDYLDLAEYGGDSQFNDQYNVNQQQQQYFVPQMSYGGDSVVPVQDGQGKPLIFYQQQQQQQQSHHQNFQLGMEYDNSNTRLGLPASMSHSVSVVSMDVSVVPESALCETSNSQPRPQKGTIELFSGHPIQIPLLTPMDREARVLRYREKKKNRKFEKTIRYASRKAYAETRPRIKGRFAKRTDVEAEVDQMFSTQLMTDSSYRIVPSF

SEQ ID NO: 69 - protein, 376 aa, Lolium temulentum
  misc_feature: Public GI ID no.47606678
  misc_feature: Bit score of 188.5 for hmm based on sequences of FIGURE 2.
  misc_feature (307)..(351): Pfam Name: CCT Pfam Description: CCT motif
  misc_feature (34)..(66): Pfam Name: zf-B_box Pfam Description: B-box zinc finger
  misc_feature: Functional Homolog Of Ceres SEEDLINE ID no. ME04315 at SEQ ID NO. 20
MNSNSSSTIYEEAVGQEGSWSRLCDGCCMVPSVVYCHADSAYLCASCDVRIHSANRVASRHERVCLSKAHEHAPALLQCRTDAVASCAAYEAQAHYANLLAGMHQCVPVVSHPATAIPAASLLAEAAVTTTILSCKEEEAFWLLLSKNSANQNCSGDNRSSSTYFGEVDEYFDLVGYNSYYDSRMNNNQAQYGMQEQQHLQPMQKEYAEKEGSECVVPSQFATVSKPQQSGYALVGSEQAASMTAGVSVYTDSVNNSISFSSMEGGIVPDNTVVDLPYSIIPTPAGASSLHSGPPLQMPLHFSSMDREAKVLRYKEKKKTRTFEKTTRYATKKAYAEARPRIKGRFAKISEAEMEVDQLFSAAALSDSSYSTVPWF

SEQ ID NO: 70 - DNA, 1350 bp, Panicum virgatum
  misc_feature: Ceres CLONE ID no.1755065
  misc_feature: Encodes the peptide sequence at SEQ ID NO 71
aaccatttccgacgcagaacccccgggggccggaatccgtgacacccacccggaggagagcagagcagaggcatcaggcatggccgccgcggtggagctggagcagaagccggcggtggggtactggggcgtggccggcgcgcggccctgcgacgcgtgcgccgcggagccggcgcggctgcactgccgcgcggacggcgcgttcctgtgccccgggtgcgacgcccgcgcgcacggcgccgggtcgcgccacgcgcgcgtctggctctgcgaggtctgtgagcacgctcccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtccgcggccttcgccaccgcggggggccagtcccagggggacgcggcggcggcggcggcggcggacgacgacgggagcaacgaggccgaggccgcctcatggctcctccccgagcccgacaccagccacgaggacagcgcagccgccaccgacgccttcttcgcggactccgacaagtacctcggcgtcgacctcgacttcgcccggtccatggacggcatcaaggccatcggcgtcccggtcgcgccgccggagctggacatcgccgctggcgctttctactaccccgaacactccatgaaccatagcgtgtcgtcatcagaggtggcggtcgtgccggacgtgctggcgggcggcgtcccggcggtgccggtggcgagccgggggaaggagcgggaagcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctccgccgaggccgaggacgaggacgaggcgctgctggagcacgaggaaggggcgtgcttctcgcccgcggtgtcggcccccgcggcctcggacggcgtcgtcccgtccttctgctaagggggacgacgggtggcggccgcgcctcctcctcctccccggctcccaggcggcaaccccttaattttgccgactctgaatcgacccccaacgcatgccaacatgcgaatgcgatgcgcgcgctccgtgtagcataataattgtacagcagctcgtccgacgcaacgagctcaatcgcggtcgcacggaacgcctgtaatcctcctcaccatccgtgtaatccagccttgtacattaccatctagaggtgtttgtgcttctcttgc

SEQ ID NO: 71 - protein, 334 aa, Panicum virgatum
  misc_feature: Ceres CLONE ID no.1755065
  misc_feature: Bit score of 736.3 for hmm based on sequences of FIGURE 2.
  misc_feature (253)..(297): Pfam Name: CCT Pfam Description: CCT motif
  misc_feature (64)..(106): Pfam Name: zf-B_box Pfam Description: B-box zinc finger
  misc_feature: Functional Homolog Of Ceres SEEDLINE ID no. ME04315 at SEQ ID NO. 20
MAAAVELEQKPAVGYWGVAGARPCDACAAEPARLHCRADGAFLCPGCDARAHGAGSRHARVWLCEVCEHAPAAVTCRADAAALCAACDADIHSANPLARRHERLPVAPFFGALADAPQPFPSAAFATAGGQSQGDAAAAAAADDDGSNEAEAASWLLPEPDTSHEDSAAATDAFFADSDKYLGVDLDFARSMDGIKAIGVPVAPPELDIAAGAFYYPEHSMNHSVSSSEVAVVPDVLAGGVPAVPVASRGKEREARLMRYREKRKNRRFDKTIRYASRKAYAETRPRIKGRFAKRCSAEAEDEDEALLEHEEGACFSPAVSAPAASDGVVPSFC

SEQ ID NO: 72 - DNA, 166 bp, Sorghum bicolor
  misc_feature: 000SORGHUM
  misc_feature: Homolog Of Ceres SEEDLINE ID no. ME00572 at SEQ ID NO. 111
tggtttcgcaaggtgaggtcttcttgaccttgcaagaccttttcttgaccttgtaagacccaactctgcgacatctctttcctgtcttacaccttcctcttcattcttacttcttttctatgtctatcccttatgagctgtgttgagctatgttaggtcctagtta

SEQ ID NO: 73 - DNA, 154 bp, Triticum aestivum
  misc_feature: 000TRITICUM
  misc_feature: Homolog Of Ceres SEEDLINE ID no. ME00572 at SEQ ID NO. 111
tcctcatgccagaattaatgttcttgaccttgtaaggccttttcttgaccttgtaaggccctccccttacgtttctccgggtgtctccaacctcacactttctccccccttctatccctcctgagctatctccatgcatattttgtctagcaat

SEQ ID NO: 74 - protein, 314 aa, Arabidopsis thaliana
  misc_feature: Ceres CLONE ID no.1844076
  misc_feature: Bit score of 824.2 for hmm based on sequences of FIGURE 3.
  misc_feature (38)..(173): Pfam Name: adh_short Pfam Description: short chain dehydrogenase
MSGKKERNKERREKRLQEISLLRTIPYSDHQRWWSQETVAVVTGANRGIGFEIARQLAGHGLTVILTSRNISVGIEATKALQEGGFSYDVHQLDILDGESISAFVEWIKQKYGGIDILVNNAGVNYNLGFDNSVEFARQVVDTNYYGTKNMIKAMIPVMKPSTAGARIVNVSSRLGRLNGRRNRIQDATLREKLTNLETLSEELIDRTVSSFLQQVEDETWQSGGWPQTFTDYSVSKLAVNAYTRLVAKELCDRPQGEKIYINCYCPGWVKTAMTGWAGNISPEVAADTGVWLSLLSDQAITGKFFAERREINF

SEQ ID NO: 75 - DNA, 1167 bp, Arabidopsis thaliana
  misc_feature: Ceres CLONE ID no.35974
  misc_feature: Encodes the peptide sequence at SEQ ID NO 76
acacccaaacacgcgacgcgagcgaaagaagacgatgacgaacaaggagaaagctcgagagagaagggagaaaaaaatgcaggagatctctctccttcgaactattccttactctgaccaccataggtggtggtcttgtgaaaatgtagcagtagtgactggttcaaaccgcgggattggattcgagattgcaagacagcttgcggttcacggattgacggttgttcttacagctagaaacgtgaatgctggtcttgaagcagttaaatctttgaggcaccaagaagaaggtctcaaggtttattttcatcaacttgatgtcacagactcttcctcgattagagagtttggttgctggcttaagcaaacatttggaggtttagatattctcgtgaataatgcaggtgttaactacaatctcggctcagataatacggttgaatttgctgaaacagttatatctactaactaccaaggaaccaaaaacatgacaaaagctatgatacccttgatgagaccatctcctcatggcgctcgtgtagtcaatgttagttctcggctaggtagagtaaatggaagacgtaatagactggcaaatgtagagttgagagatcagctaagcagtccagatttgctgaccgaggaacttatagacagaactgtctctaaattcatcaaccaagtaaaagacggaacttgggaatcaggcgggtggcctcagacattcactgactactccatgtctaagcttgcagtcaatgcttacacgagactaatggcaaaagaacttgagagacgaggagaggaagagaagatttatgttaacagcttttgccctggttgggtgaagactgcgatgactggctacgccggaaatatgccacctgaagatgcagctgatactggagtttggcttagcctggtcctttccgaagagtcagtaaccggaaaattcttcgcagagagacgtgagatcaacttctgagggttgttgaatgtttgtaaacgttggaatagattgtgtcgtcttcgtttagtgccatagttttagtcaaaggtttacaaaatcaattgtaattggtaagtgaatggttgtagtcatgatacgcgtcagatttgccacaaaactaggagtttataatttaaatataattaatttttaattgc

SEQ ID NO: 76 - protein, 316 aa, Arabidopsis thaliana
  misc_feature: Ceres CLONE ID no.35974
  misc_feature: Bit score of 817.6 for hmm based on sequences of FIGURE 3.
  misc_feature (37)..(174): Pfam Name: adh_short Pfam Description: short chain dehydrogenase
  misc_feature: Functional Homolog Of Full Length Ceres SEEDLINE ID no.ME17294 at SEQ ID NO. 74
MTNKEKARERREKKMQEISLLRTIPYSDHHRWWSCENVAVVTGSNRGIGFEIARQLAVHGLTVVLTARNVNAGLEAVKSLRHQEEGLKVYFHQLDVTDSSSIREFGCWLKQTFGGLDILVNNAGVNYNLGSDNTVEFAETVISTNYQGTKNMTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEESVTGKFFAERREINF

SEQ ID NO: 77 - protein, 304 aa, Arabidopsis thaliana
  misc_feature: Public GI ID no.10176876
  misc_feature: Bit score of 730.9 for hmm based on sequences of FIGURE 3.
  misc_feature (23)..(160): Pfam Name: adh_short Pfam Description: short chain dehydrogenase
  misc_feature: Functional Homolog Of Full Length Ceres SEEDLINE ID no.ME17294 at SEQ ID NO. 74
MQEISLLRTIPYSDHHRWWSCENVAVVTGSNRGIGFEIARQLAVHGLTVVLTARNVNAGLEAVKSLRHQEEGLKVYFHQLDVTDSSSIREFGCWLKQTFGGLDILVNNAGVNYNLGSDNTVEFAETVISTNYQGTKNMTKAMIPLMRPSPHGARVVNVSSRLENLVEIHELQRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 78 - DNA, 1164 bp, Glycine max
  misc_feature: Ceres CLONE ID no.473040
  misc_feature: Encodes the peptide sequence at SEQ ID NO 79
acttcttaaaactggtatctgatttacaaaaggttacaaacttctcttgcataaagaatggcatcagcaacaataaggaatgcagttgtcacgggagcaaacaaagggataggatttggaatatgcaagcaattggtttctaatggcatcacagtggtgctaacagcaagggatgagaaaaggggtcttgaagctgttgaaaagctgaaagagtttggtgtgtctgatcaagtggtgtttcatcagcttgatgtgactgaccctaaaagcattgaatcccttgcaaatttcatcaaaacccagtttggaaaacttgatatcttggtgaataatgcaggaattcatggagcatatgttgaccgtgatgctttagctgctgctggggaaaaagttgccaatgttgattggagaaaaatctcaactgaaaattttgaagctgccgaagcaggcattagaacaaattactatggagtcaaattaatgtgtgaagcacttattccccttctagaattgtcaggcacaccaaggattgtcaatgtttcctcctccatggggaagttggagaaaataccaaatgcatgggctagaggagccctaagtgatgctgagagcctaacagaagaaaaggtggatgaggttttgaatcagtttctaaaagattttaaagagggttcattagaaaccaaagggtggccacatgctttttctgcatatatagtctcaaaagctgctttgactgcctacacaaggattcttgctaagaagtacccatctttctgcatcaatgctgtttgccctggctttgtgaaaacagatctcaactacaatactggctatcttagtgttgatgaaggtgctgaaagtgttgtaaggttggctctgctacctaatggaggtccttctggtctattcttttctcgaagtgaagtggcaccattctgatccaaagactgttgtgtacttgaagaggataaataataagcatggtttcatgataagacatgtatcaaatttgtacctagcacaacaagaaaataagccacatgtctgatcactgatggctgcccatcattgatgagaacaaccctatagtgaattctagatattacaatgacattactaatttgagaaatctaattttggatataaagatatctgtttgtc

SEQ ID NO: 79 - protein, 294 aa, Glycine max
  misc_feature: Ceres CLONE ID no.473040
  misc_feature: Bit score of 656.1 for hmm based on sequences of FIGURE 3.
  misc_feature (7)..(168): Pfam Name: adh_short Pfam Description: short chain dehydrogenase
  misc_feature: Functional Homolog Of Full Length Ceres SEEDLINE ID no.ME17294 at SEQ ID NO. 74
MASATIRNAVVTGANKGIGFGICKQLVSNGITVVLTARDEKRGLEAVEKLKEFGVSDQVVFHQLDVTDPKSIESLANFIKTQFGKLDILVNNAGIHGAYVDRDALAAAGEKVANVDWRKISTENFEAAEAGIRTNYYGVKLMCEALIPLLELSGTPRIVNVSSSMGKLEKIPNAWARGALSDAESLTEEKVDEVLNQFLKDFKEGSLETKGWPHAFSAYIVSKAALTAYTRILAKKYPSFCINAVCPGFVKTDLNYNTGYLSVDEGAESVVRLALLPNGGPSGLFFSRSEVAPF

SEQ ID NO: 80 - DNA, 2073 bp, Triticum aestivum
  misc_feature: Ceres CLONE ID no.922223
  misc_feature: Encodes the peptide sequence at SEQ ID NO 81
gtaaacaagcccatggactcttattttctctttatgttgggcttaatgttcttggggctatggttccgagttctcaaaaaaaaaagttcgattccggcgaacacagtacagcagagggagcgagagatggggaagaagggcaaggcggcggcaagggagcgccgggaggagcggcggcgggaagtcacgctcctccgcgccgtaccctacgagccccaccagcggtggtgggacggcctcgcgccggcgcgcgccgtggcggtggtgacgggggccagccgcggcatcggctacgagatctcccgccagctcgcgcgccacggcctccacgtcgtcctcgcctcgcgcgacgccgcgcggggcagggacgccgcggaggggatcctccgcgaggagggcacgagcgcggagtggcggcagctcgacgtggcggacgccgcgtcggtcgaggccttcgccgcctggacggcgcggacccacggcggcatccatgtccttattaacaatgcaggtgtaaacttcaacagaggagcagataactctgttgaatttgcagagcaagtaattgagacaaattattttggtacaaggcggatgattgaagccatgctaccattactgaaaccttctccgtatggtggccggatagtgaatgtgagctcaaggcttggcagggccaatggcagacgcaataaaatcggcgatgcgatcctaagagagcaactattaactgatgattgcttatctgaggaattgattgatgggatggtcactaaattccttgaacaagtgaagcaaaatagttggtcctccattgagtggcctcagatgtacacggactattcggtctcaaagtttgctgttaatgtgtatacaagactcatggcaaggaggttatctgacaggtctgaaggccaaaagatttacattaactgtttctgtcctggctgggtaaagactgccatgactgattgggaagggaacatttcagccgaagaaggtgctgatactggagtgtggcttgctctgttaccccaggaacaagcaacaattggaaagttctatgctgagagacgcgagataagcttctgaggtgatcggaatggtggatatgcgagtgggagtggtacatttaaccatatgtatttaattaaagttttaaactatgtaggtgatcggaatggtggatatgcgagtgggagtggcatgttcatgaagagcaatccacatgattggcagactccagcatggttttcgagtcgcgactcatgcgagttgctctggggcagcgactcggaagaagtcgagcctgcgttgtgactagtcatgactcagagtcgcgagtcgatactaagctgagttgaccatatttttgcgactcatagactagtcgtcgactagtcgcaactagtcgagcgactcgaaatccatggactccagtcggtcaaagagcattgagtcttcacactgatggaaggccatgctctctaattttgtcaataaatgatgcagtaccagatgctttcagacgatactcagacgacgttgcccatcagaccgtttgttaattagattcacgtcaatctcatggtgtagagtctgcgtcggctgcacatcggccataccatgtcgtgtgtacatcaatttcgtgaagttgctggaaacagggaaatgttcaccaggcccaccaccactagtccacaacggcagtaagcaggcatggcatgctggactgctgcaccgaatatatgattaggctggatctcaagcaactccactgtcagattctctcattatcttccaagtagaggtggaatccttatgacccaatggatgagagcgatgcaacgctgcctcacccacgcatgcagaagatcgatatgtttgggaacgaaccggtcggcctaccttgggaattctggagctatagtcatggctaggccgccattcatggaccggagactacatgtcttgcagtatattgttctgattttgccgccacctgcatatgtgtggtacatactttgttatgttcgtgtttgtatgcaatggttggatcgtgtgatttgctgg

SEQ ID NO: 81 - protein, 321 aa, Triticum aestivum
  misc_feature: Ceres CLONE ID no.922223
  misc_feature: Bit score of 823.6 for hmm based on sequences of FIGURE 3.
  misc_feature (43)..(179): Pfam Name: adh_short Pfam Description: short chain dehydrogenase
  misc_feature: Functional Homolog Of Full Length Ceres SEEDLINE ID no.ME17294 at SEQ ID NO. 74
MGKKGKAAARERREERRREVTLLRAVPYEPHQRWWDGLAPARAVAVVTGASRGIGYEISRQLARHGLHVVLASRDAARGRDAAEGILREEGTSAEWRQLDVADAASVEAFAAWTARTHGGIHVLINNAGVNFNRGADNSVEFAEQVIETNYFGTRRMIEAMLPLLKPSPYGGRIVNVSSRLGRANGRRNKIGDAILREQLLTDDCLSEELIDGMVTKFLEQVKQNSWSSIEWPQMYTDYSVSKFAVNVYTRLMARRLSDRSEGQKIYINCFCPGWVKTAMTDWEGNISAEEGADTGVWLALLPQEQATIGKFYAERREISF

SEQ ID NO: 82 - protein, 331 aa, Oryza sativa subsp. indica
  misc_feature: Public GI ID no.125528967
  misc_feature: Bit score of 831.3 for hmm based on sequences of FIGURE 3.
  misc_feature (49)..(188): Pfam Name: adh_short Pfam Description: short chain dehydrogenase
  misc_feature: Functional Homolog Of Full Length Ceres SEEDLINE ID no.ME17294 at SEQ ID NO. 74
MGKKGKEAARERREQRRREVTLLRAVPYEPHQRWWDGLAPPPPPPPGRAVAVVTGANRGIGYEAARQLATHGLHVVLTSRDAARGRDAAEQIRAAAGKPGVSVEWRQLDVTDAASVEGFATWVERTHGGVHVLVNNAGVNFNRGADNSVEFAEQVTETNYFGTKRMIEAMMPLMITSPHGGRIVNVSSRLGRVNGRRNRIGDPSLRERLLNDDHLSEELINEMVMKFLEQTKQDNWSSSNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 83 - protein, 330 aa, Oryza sativa subsp. japonica
  misc_feature: Public GI ID no.125573200
  misc_feature: Bit score of 834.6 for hmm based on sequences of FIGURE 3.
  misc_feature (48)..(187): Pfam Name: adh_short Pfam Description: short chain dehydrogenase
  misc_feature: Functional Homolog Of Full Length Ceres SEEDLINE ID no.ME17294 at SEQ ID NO. 74
MGKKGKEAARERREQRRREVTLLRAVPYEPHQRWWDGLAPPPPPPGRAVAVVTGANRGIGYEAARQLATHGLHVVLTSRDAARGRDATEQIRAAAGKPGVSVEWRQLDVTDAASVEGFATWVERTHGGVHVLVNNAGVNFNRGADNSVEFAEQVIETNYFGTKRMIEAMMPLMITSPHGGRIVNVSSRLGRVNGRRNRIGDPSLRERLLNDDHLSEELINEMVMKFLEQTKQDNWSSGNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 84 - DNA, 942 bp, Populus balsamifera subsp. trichocarpa
  misc_feature: Ceres ANNOT ID no.1527409
  misc_feature: Encodes the peptide sequence at SEQ ID NO 85
atgggaagtaaagagccagcaaaggaaaagagagaaaaaagactccaagaaatttctcttctccgtaccattccttactctgatcatcaaaggtggtggtcatcagaaactgttgctgtggtgaccggtggaaatagaggaataggatttgagattgcgaggcaacttgcagaccatggattgtctgttatcctgacatcacgagaaagtagcgcaggccttgaagctgccaatgtcttgcgagagttgggtttgagtgtggacttccatcaacttgatgtcttagattctttatccatcaaaacgtttgctgagtggatacaacaaacttacggcggattagatgttttggtgaataatgctggtgttaattacaatatggggtctgacaattctgttgaaaatgccaagaatgttgttgatacaaactattatggtatcaaaaatgtcactgaagctctgattcctttgatgagaccttcttctgtaggtgctcgtattgttaatgtaagttcacggcttggaagactaaatggcaaacgaaacagacttgaagacaaagatttgagagagcaactggctaacctggaaacactttcagaggaactcattgataggacggtgtctactttcctacaacaagtagaagaccgcacatatacatcaggtggatggcctcaggtgaacactgattactcggtgtcaaaacttgcagttaatgcttatactaggctaatggcaaagaaactgtccgatcggcctaatggtcagaagatctatataaactgctactgcccagggtgggtgaagacagctatgacaggctgggctggtaatgtatcagctgaggatggagctgacacaggagtatggctggccctgcttccagaccaagcaatcacagggaaattttttgctgagagacgtgaggtaaacttctga

SEQ ID NO: 85 - protein, 313 aa, Populus balsamifera subsp. trichocarpa
  misc_feature: Ceres ANNOT ID no.1527409
  misc_feature: Bit score of 836.2 for hmm based on sequences of FIGURE 3.
  misc_feature (37)..(172): Pfam Name: adh_short Pfam Description: short chain dehydrogenase
  misc_feature: Functional Homolog Of Full Length Ceres SEEDLINE ID no.ME17294 at SEQ ID NO. 74
MGSKEPAKEKREKRLQEISLLRTIPYSDHQRWWSSETVAVVTGGNRGIGFEIARQLADHGLSVILTSRESSAGLEAANVLRELGLSVDFHQLDVLDSLSIKTFAEWIQQTYGGLDVLVNNAGVNYNMGSDNSVENAKNVVDTNYYGIKNVTEALIPLMRPSSVGARIVNVSSRLGRLNGKRNRLEDKDLREQLANLETLSEELIDRTVSTFLQQVEDRTYTSGGWPQVNTDYSVSKLAVNAYTRLMAKKLSDRPNGQKIYINCYCPGWVKTAMTGWAGNVSAEDGADTGVWLALLPDQAITGKFFAERREVNF

SEQ ID NO: 86 - protein, 311 aa, Medicago truncatula
  misc_feature: Public GI ID no.92871098
  misc_feature: Bit score of 828.1 for hmm based on sequences of FIGURE 3.
  misc_feature (35)..(170): Pfam Name: adh_short Pfam Description: short chain dehydrogenase
  misc_feature: Functional Homolog Of Full Length Ceres SEEDLINE ID no.ME17294 at SEQ ID NO. 74
MGHKEKSRKDKRLQEISLLRTIPYSDHQRWWSKETIAVVTGGNRGIGFEISRQLADHGVTVVLTSRDASVGVESIKVLQEGGLDVHCHQLDILDSSSVNEFAEWLKEEYGGLDILVNNAGVNSNMGSDNSVENARKCIETNYYGTKRMIEAMIPLMKPSAAGGRIVNVSSRLGRLNGKRNRIENEELREKLSDVESLSEELIDETINNFLQQIEDGSWKTGGWPQTFTDYSVSKLAVNTYTRYMAKKLSDRPEGEKIYINCYCPGWVKTALTGYAGSVTVEQGADTGVWIALVPDQEITGKFFAERREINF

SEQ ID NO: 87 - DNA, 1171 bp, Panicum virgatum
  misc_feature: Ceres CLONE ID no.1831117
  misc_feature: Encodes the peptide sequence at SEQ ID NO 88
ctcccacccgcgctcccagcacgcccaccgtcgcctaccccgtctccagctcgatggactactcgagcaccaaggagttacctccggccggggcctggtggtcgagggagacggtggccgtggtgacgggcgcgaaccggggcatcgggcacgccctcgccgcgcgcctggcggagcacgggctcaccgtggtgctcaccgcgcgggacggcgcgcgcggggaggccgccgcggccccgctccgcgcgcgcgggctcgccgtcgccttccgcaggctcgacgtctccgacgccgcctccgtcgccgagttcgccgcctggctccgcgacgccgtcggcggcctcgacatcctggtgaacaacgccgccgtgtccttcaacgagatcgacaccaactcggtggagcacgccgagacggtcctccggaccaacttctacggcgccaagatgctcacggaagcgctcctgccgctgttccggcagtccccggccaccagcaggatcctcaacatcagctcgcagctcggccttctcaacaaggtgagcgacccgtccctgaaggcgttgctgctggacgaggagaccctgacggaggcggcgatcgacgccatggtgtcgcggttcctggcgcaggtgaaggacgggacgtggggcgcgcagggttggcccaaggtgtggacggactactcggtctccaagctggccctgaacgcctactcccggctgctggcgcggcggctgcaggcgcgcggcgcccgcgtgagcgtcaactgcttctgccccgggttcacgcgcaccgacatgaccaggggctgggggaagcgcaccgccgaggaggcggccgacgtcggcgcgcggctcgcgctgctgccgcccggcgagctccccacgggggccttcttcaagtggtgcacgccgcagccctactccaagctgtgacctgccgagccacgccgccggcccgcgcgccccggccatggcggccgcaggagtatgtagcgttggtttagctgcttctagttactttcaatgcagacaagaagccgatcgagtagtgtctcttagcagtctggctttctgccaaggtgctttggttgagcaatgcaaccaaaccatgtcagcgatcaatgtactatgcgtgcttagccgtgcaagatttaggtcaacttccg

SEQ ID NO: 88 - protein, 294 aa, Panicum virgatum
  misc_feature: Ceres CLONE ID no.1831117
  misc_feature: Bit score of 671.6 for hmm based on sequences of FIGURE 3.
  misc_feature (20)..(160): Pfam Name: adh_short Pfam Description: short chain dehydrogenase
  misc_feature: Functional Homolog Of Full Length Ceres SEEDLINE ID no.ME17294 at SEQ ID NO. 74
MDYSSTKELPPAGAWWSRETVAVVTGANRGIGHALAARLAEHGLTVVLTARDGARGEAAAAPLRARGLAVAFRRLDVSDAASVAEFAAWLRDAVGGLDILVNNAAVSFNEIDTNSVEHAETVLRTNFYGAKMLTEALLPLFRQSPATSRILNISSQLGLLNKVSDPSLKALLLDEETLTEAAIDAMVSRFLAQVKDGTWGAQGWPKVWTDYSVSKLALNAYSRLLARRLQARGARVSVNCFCPGFTRTDMTRGWGKRTAEEAADVGARLALLPPGELPTGAFFKWCTPQPYSKL

SEQ ID NO: 89 - DNA, 951 bp, Arabidopsis thaliana
  misc_feature: Ceres ANNOT ID no.857222
  misc_feature: Encodes the peptide sequence at SEQ ID NO 90
atgacgaacaaggagaaagctcgagagagaagggagaaaagaatgcaggagatctctctccttcgaactattccttactctgaccaccataggtggtggtcttgtgaaaatgtagcagtagtgactggttcaaaccgcgggattggattcgagattgcaagacagcttgcggttcacggattgacggttgttcttacagctagaaacgtgaatgctggtcttgaagcagttaaatctttgaggcaccaagaagaaggtctcaaggtttattttcatcaacttgatgtcacagactcttcgtcgattagagagtttggttgctggcttaagcaaacatttggaggtttagatattctcgtgaataatgcaggtgttaactacaatctcggctcagataatacggttgaatttgctgaaacagttatatctactaactaccaaggaaccaaaaacatgacaaaagctatgatacccttgatgagaccatctcctcatggcgctcgtgtagtcaatgttagttctcggctaggtagagtaaatggaagacgtaatagactggcaaatgtagagttgagagatcagctaagcagtccagatttgctgaccgaggaacttatagacagaactgtctctaaattcatcaaccaagtaaaagacggaacttgggaatcaggcgggtggcctcagacattcactgactactccatgtctaagcttgcagtcaatgcttacacgagactaatggcaaaagaacttgagagacgaggagaggaagagaagatttatgttaacagcttttgccctggttgggtgaagactgcgatgactggctacgccggaaatatgccacctgaagatgcagctgatactggagtttggcttagcctggtcctttccgaagaggcagtaaccggaaaattcttcgcagagagacgtgagatcaacttctga

SEQ ID NO: 90 - protein, 316 aa, Arabidopsis thaliana
  misc_feature: Ceres ANNOT ID no.857222
  misc_feature: Bit score of 823.3 for hmm based on sequences of FIGURE 3.
  misc_feature (37)..(174): Pfam Name: adh_short Pfam Description: short chain dehydrogenase
  misc_feature: Functional Homolog Of Full Length Ceres SEEDLINE ID no.ME17294 at SEQ ID NO. 74
MTNKEKARERREKRMQEISLLRTIPYSDHHRWWSCENVAVVTGSNRGIGFEIARQLAVHGLTVVLTARNVNAGLEAVKSLRHQEEGLKVYFHQLDVTDSSSIREFGCWLKQTFGGLDILVNNAGVNYNLGSDNTVEFAETVISTNYQGTKNMTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 91 - DNA, 1213 bp, Triticum aestivum
  misc_feature: Expected Sequence
  misc_feature: Encodes the peptide sequence at SEQ ID NO. 93
acacggctgtggtttcaattttatttcatctctatccaattgagtgatggaacggctgagagtagtggtgcctaattgcctgagctgtattgagttctgaatattcatgttcaaaaaattcctactaccatgcatagaagtctgaatatttagcagaaaatagcttggacatgggcagtctaaaaatgatattcagtttcatacatgtgagactatgatacataggttctgcacaaagcaaggaggaaaccgatatgcaatgagtggttaggtgctgatactggcagatttttgtctgaatatctctggtaacccagctacagattaacaatgcaggtgtaaacttcaacagaggagcagataactctgttgaatttgcagagcaagtaattgagacaaattattttggtacaaagcggatgattgaagccatgctaccattactgaaaccttctccgtatggtggccggatagtgaatgtaagctcaaggcttggtagggccaatggcaggcgcaataaaatcggcgatgcgatcctaagagagcaactattaactgatgattgcttatctgaagaattgatttgatgggattgtcactaaattccttgaacaagtgaagcaaaatagttggtcctccattgagtggcctcagatgtacacggactattctatytcaaagcttgctgttaatgtgtatacaagactcatggctaagaggcttgctgacaggtytgaaggccaaaagatttacattaactgtttctgtcctggctgggtaaagactgccatgactgattgggaagggaacatttmagycgaagaaggtgctgatactggagtgtggcttgmtctgttaccccaggcacaagcaacaattggaaagttctatgctgagagacgcgagataagcttctgaggtgactagtcttgtccatacttttgctccagctagacagctacaagttgaaattttccatagttttgcccccagctataagtagagaaaagccatgacccaaggttcgtatgttcaaattgctttgtgttacttgcacctattggcatagaagtgatacatgcttacttttatctatgtcctcttaaagggcttgtggtttgctttttattttgcacgttagctgaagagcagtagaactgagatgtgttcccatttcctctgatatttaatgcagtaacggatccatctttct

SEQ ID NO: 92 - DNA, 1212 bp, Triticum aestivum
  misc_feature: Inplanta Sequence
  misc_feature: Encodes the peptide sequence at SEQ ID NO. 93
acacggctgtggtttcaattttatttcatctctatccaattgagtgatggaacggctgagagtagtggtgcctaattgcctgagctgtattgagttctgaatattcatgttcaaaaaattcctactaccatgcatagaagtctgaatatttagcagaaaatagcttggacatgggcagtctaaaaatgatattcagtttcatacatgtgagactatgatacataggttctgcacaaagcaaggaggaaaccgatatgcaatgagtggttaggtgctgatactggcagatttttgtctgaatatctctggtaacccagctacagattaacaatgcaggtgtaaacttcaacagaggagcagataactctgttgaatttgcagagcaagtaattgagacaaattattttggtacaaagcggatgattgaagccatgctaccattactgaaaccttctccgtatggtggccggatagtgaatgtaagctcaaggcttggtagggccaatggcaggcgcaataaaatcggcgatgcgatcctaagagagcaactattaactgatgattgcttatctgaggaattgattggtgggattgtcactaaattccttgaacaagtgaagcaaaatagttggtcctccattgagtggcctcagatgtacacggactattctatctcaaagcttgctgttaatgtgtatacaagactcatggctaagaggcttgctgacaggtctgaaggccaaaagatttacattaactgtttctgtcctggctgggtaaagactgccatgactgattgggaagggaacatttcagccgaagaaggtgctgatactggagtgtggcttgctctgttaccccaggcacaagcaacaattggaaagttctatgctgagagacgcgagataagcttctgaggtgactagtcttgtccatacttttactccagctagacagctacaagttgaaattttccatagttttgcccccagctataagtagagaaaagccatgacccaaggttcgtatgttcaaattgctttgtgttacttgcacctattggcatagaagtgatacatgcttacttttatctatgtcctcttaaagggcttgtggtttgctttttattttgcacgttagctgaagagcagtagaactgagatgtgttcccatttcctctgatatttaatgcagtaacggatccatctttct

SEQ ID NO: 93 - protein, 165 aa, Triticum aestivum
  misc_feature: Functional Homolog Of Ceres SEEDLINE ID no.ME17294 at SEQ ID NO. 93
  misc_feature: Bit score of 449.7 for hmm based on sequences of FIGURE 4.
MIEAMLPLLKPSPYGGRIVNVSSRLGRANGRRNKIGDAILREQLLTDDCLSEELIGGIVTKFLEQVKQNSWSSIEWPQMYTDYSISKLAVNVYTRLMAKRLADRSEGQKIYINCFCPGWVKTAMTDWEGNISAEEGADTGVWLALLPQAQATIGKFYAERREISF

SEQ ID NO: 94 - DNA, 1171 bp, Panicum virgatum; identical to SEQ ID NO: 87
  misc_feature: Ceres CLONE ID no.1831117
  misc_feature: Encodes the peptide sequence at SEQ ID NO 95

SEQ ID NO: 95 - protein, 163 aa, Panicum virgatum
  misc_feature: Ceres CLONE ID no.1831117
  misc_feature: Bit score of 411.8 for hmm based on sequences of FIGURE 4.
  misc_feature: Functional Homolog Of Ceres SEEDLINE ID no.ME17294 at SEQ ID NO. 93
MLTEALLPLFRQSPATSRILNISSQLGLLNKVSDPSLKALLLDEETLTEAAIDAMVSRFLAQVKDGTWGAQGWPKVWTDYSVSKLALNAYSRLLARRLQARGARVSVNCFCPGFTRTDMTRGWGKRTAEEAADVGARLALLPPGELPTGAFFKWCTPQPYSKL

SEQ ID NO: 96 - protein, 164 aa, Medicago truncatula
  misc_feature: Public GI ID no.92871098
  misc_feature: Truncated
  misc_feature: Bit score of 389.1 for hmm based on sequences of FIGURE 4.
  misc_feature: Functional Homolog Of Ceres SEEDLINE ID no.ME17294 at SEQ ID NO. 93
MIEAMIPLMKPSAAGGRIVNVSSRLGRLNGKRNRIENEELREKLSDVESLSEELIDETINNFLQQIEDGSWKTGGWPQTFTDYSVSKLAVNTYTRYMAKKLSDRPEGEKIYINCYCPGWVKTALTGYAGSVTVEQGADTGVWIALVPDQEITGKFFAERREINF

SEQ ID NO: 97 - DNA, 1243 bp, Gossypium hirsutum
  misc_feature: Ceres CLONE ID no.1844076
  misc_feature: Truncated
  misc_feature: Encodes the peptide sequence at SEQ ID NO 98
atttcagtccaataactttcctagaccttatttgcgtttcagctccgtgcatccatttactttctccttctccattttgactcgtcacctcaaaattgccccacacctgaaagacggagcaaacactaggatatgtcagggaaaaaggaaagaaacaaggagagaagagaaaagagactccaagagatttcacttctcaggaccattccttattctgatcatcaaaggtggtggtcacaagaaactgttgcagttgtaactggtgctaatagaggaatcgggtttgagattgcaagacaacttgccgggcatggattgacagtaatactaacatcaaggaacattagtgtcggcattgaagcaaccaaggccttacaagaagggggtttcagttatgatgttcatcagcttgatatcttggatggtgaatcaatttcagcgtttgttgaatggataaaacaaaaatacggtggcattgatatcctggtgaataatgcaggtgttaactacaacctcgggttcgataattctgtggaattcgcacgacaggtagttgacaccaattattatggcactaaaaatatgattaaagcaatgataccagtaatgaaaccttccactgctggtgctcgtatcgttaatgtaagctcacggctaggcagactaaacggccgccgcaatagaattcaagatgcaactttgagagaaaaactaactaatttggaaactctctcagaggaattgattgatagaacagtgtctagtttcttacaacaagttgaagatgaaacttggcaatcaggcggatggcctcaaacattcactgattactctgtatctaaacttgctgtcaatgcttacaccagactggtggccaaagaactctgcgatcgaccacaaggcgaaaagatatatatcaactgttattgtccaggatgggtgaagactgcaatgacaggttgggcaggcaatatttctcctgaggttgcagctgacactggagtctggctttccttgctttctgaccaagcaataactggaaagttttttgcagagagacgagaaatcaacttttgagtaaattaagttctgcattgtagagtcaaaaatttgttctattcttgaagattcgatgaaacagttgaaagtaacttgttttagaagcaatttggcccatacgtagcaccaaactaaaaccgaacatatgaatcaatgctgctttctgtctaaccttaaaagaccc

SEQ ID NO: 98 - protein, 164 aa, Gossypium hirsutum
  misc_feature: Ceres CLONE ID no.1844076
  misc_feature: Bit score of 438.0 for hmm based on sequences of FIGURE 4.
  misc_feature: Truncated
  misc_feature: Functional Homolog Of Ceres SEEDLINE ID no.ME17294 at SEQ ID NO. 93
MIKAMIPVMKPSTAGARIVNVSSRLGRLNGRRNRIQDATLREKLTNLETLSEELIDRTVSSFLQQVEDETWQSGGWPQTFTDYSVSKLAVNAYTRLVAKELCDRPQGEKIYINCYCPGWVKTAMTGWAGNISPEVAADTGVWLSLLSDQAITGKFFAERREINF

SEQ ID NO: 99 - DNA, 1167 bp, Arabidopsis thaliana; identical to SEQ ID NO: 75
  misc_feature: Ceres CLONE ID no.35974
  misc_feature: Encodes the peptide sequence at SEQ ID NO 100

SEQ ID NO: 100 - protein, 165 aa, Arabidopsis thaliana
  misc_feature: Ceres CLONE ID no.35974
  misc_feature: Bit score of 357.4 for hmm based on sequences of FIGURE 4.
  misc_feature: Truncated
  misc_feature: Functional Homolog Of Ceres SEEDLINE ID no.ME17294 at SEQ ID NO. 93
MTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEESVTGKFFAERREINF

SEQ ID NO: 101 - protein, 165 aa, Arabidopsis thaliana
  misc_feature: Public GI ID no.110737329
  misc_feature: Bit score of 355.4 for hmm based on sequences of FIGURE 4.
  misc_feature: Functional Homolog Of Ceres SEEDLINE ID no.ME17294 at SEQ ID NO. 93
MTKAMIPLMRPSPHGARVVNVSSRLGRVNGRRNRLANVELRDQLSSPDLLTEELIDRTVSKFINQVKDGTWESGGWPQTFTDYPMSKLAVNAYTRLMAKELERRGEEEKIYVNSFCPGWVKTAMTGYAGNMPPEDAADTGVWLSLVLSEEAVTGKFFAERREINF

SEQ ID NO: 102 - protein, 167 aa, Arabidopsis thaliana
  misc_feature: Public GI ID no.10176876
  misc_feature: Bit score of 316.9 for hmm based on sequences of FIGURE 4.
  misc_feature: Truncated
  misc_feature: Functional Homolog Of Ceres SEEDLINE ID no.ME17294 at SEQ ID NO. 93
MTKAMIPLMRPSPHGARVVNVSSRLENLVEIHELQRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 103 - DNA, 1164 bp, Glycine max; identical to SEQ ID NO: 78
  misc_feature: Ceres CLONE ID no.473040
  misc_feature: Encodes the peptide sequence at SEQ ID NO 104

SEQ ID NO: 104 - protein, 153 aa, Glycine max
  misc_feature: Ceres CLONE ID no.473040
  misc_feature: Bit score of 360.8 for hmm based on sequences of FIGURE 4.
  misc_feature: Truncated
  misc_feature: Functional Homolog Of Ceres SEEDLINE ID no.ME17294 at SEQ ID NO. 93
MCEALIPLLELSGTPRIVNVSSSMGKLEKIPNAWARGALSDAESLTEEKVDEVLNQFLKDFKEGSLETKGWPHAFSAYIVSKAALTAYTRILAKKYPSFCINAVCPGFVKTDLNYNTGYLSVDEGAESVVRLALLPNGGPSGLFFSRSEVAPF

SEQ ID NO: 105 - DNA, 2073 bp, Triticum aestivum; identical to SEQ ID NO: 80
  misc_feature: Ceres CLONE ID no.922223
  misc_feature: Encodes the peptide sequence at SEQ ID NO 106

SEQ ID NO: 106 - protein, 165 aa, Triticum aestivum
  misc_feature: Ceres CLONE ID no.922223
  misc_feature: Bit score of 455.9 for hmm based on sequences of FIGURE 4.
  misc_feature: Truncated
  misc_feature: Functional Homolog Of Ceres SEEDLINE ID no.ME17294 at SEQ ID NO. 93
MIEAMLPLLKPSPYGGRIVNVSSRLGRANGRRNKIGDAILREQLLTDDCLSEELIDGMVTKFLEQVKQNSWSSIEWPQMYTDYSVSKFAVNVYTRLMARRLSDRSEGQKIYINCFCPGWVKTAMTDWEGNISAEEGADTGVWLALLPQEQATIGKFYAERREISF

SEQ ID NO: 107 - protein, 166 aa, Oryza sativa subsp. indica
  misc_feature: Public GI ID no.125528967
  misc_feature: Bit score of 452.6 for hmm based on sequences of FIGURE 4.
  misc_feature: Truncated
  misc_feature: Functional Homolog Of Ceres SEEDLINE ID no.ME17294 at SEQ ID NO. 93
MIEAMMPLMITSPHGGRIVNVSSRLGRVNGRRNRIGDPSLRERLLNDDHLSEELINEMVMKFLEQTKQDNWSSSNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 108 - protein, 158 aa, Oryza sativa subsp. japonica
  misc_feature: Public GI ID no.115442007
  misc_feature: Truncated
  misc_feature: Bit score of 417.1 for hmm based on sequences of FIGURE 4.
  misc_feature: Functional Homolog Of Ceres SEEDLINE ID no.ME17294 at SEQ ID NO. 93
MITSPHGGRIVNVSSRLGRVNGRRNRIGDPSLRERLLNDDHLSEELINEMVMKFLEQTKQDNWSSGNEWPQMYTDYSISKLAVNAYTRLLARRLLDRPEGQKIYINCFCPGWVKTAMTGWEGNISAEEGADTGVWLALVPQEQATIGKFFAERREISF

SEQ ID NO: 109 - DNA, 951 bp, Arabidopsis thaliana; identical to SEQ ID NO: 89
  misc_feature: Ceres ANNOT ID no.857222
  misc_feature: Encodes the peptide sequence at SEQ ID NO 110

SEQ ID NO: 110 - protein, 165 aa, Arabidopsis thaliana
  misc_feature: Ceres ANNOT ID no.857222
  misc_feature: Truncated
  misc_feature: Bit score of 401.6 for hmm based on sequences of FIGURE 4.
  misc_feature: Functional Homolog Of Ceres SEEDLINE ID no.ME17294 at SEQ ID NO. 93
MTKAMIPLMRPSPHGARVVNVSSRLGRVNGRRNRLANVELRDQLSSPDLLTEELIDRTVSKFINQVKDGTWESGGWPQTFTDYSMSKLAVNAYTRLMAKELERRGEEEKIYVNSFCPGWVKTAMTGYAGNMPPEDAADTGVWLSLVLSEEAVTGKFFAERREINF

SEQ ID NO: 111 - DNA, 557 bp, Arabidopsis thaliana
  misc_feature: Ceres SEEDLINE ID no. ME00572
  misc_feature: Inplanta Sequence
atcccaccgtttcttaagactctctctctctttctgttttctatttctctctctctcaaatgaaagagagagaagagctcccatggatgaaaatagcgagaccgaagtttctccaaggcattaaggaaaacataacctccgtgatgcatagagattattggatccgctgtgctgagacattgagtttttcttcggcattccagtttcaatgataaaggggtgttatcctatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcc

SEQ ID NO: 112 - protein, 859 aa, Arabidopsis thaliana
  misc_feature: Ceres LOCUS ID no. AT5G62000
  misc_feature: Is Acted Upon By Ceres SEEDLINE ID no. ME00572 at SEQ ID NO. 111
  misc_feature: Bit score of 2157.8 for hmm based on sequences of FIGURE 5.
  misc_feature (163)..(268): Pfam Name: B3 Pfam Description: B3 DNA binding domain
  misc_feature (290)..(372): Pfam Name: Auxin_resp Pfam Description: Auxin response factor
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 113 - DNA, 2538 bp, Populus balsamifera subsp. trichocarpa
  misc_feature: Ceres ANNOT ID no.1527370
  misc_feature: Encodes the peptide sequence at SEQ ID NO. 114
atggcttcttcagagatttcagcgaaagctaacagtggaaacattagaggaggaggagagagcttcacttctggttacagtgaagccatggaagggcagaaaaatcattctactcatccaagttcagctagagttgtagatgctgaaacggcgctgtataatgagctatggcatgcttgtgctggtcctttagtgactgtacctcgtgaaggagatcgtgtgttttatttccctcaaggacatatagagcaggtggaggcatcaacgaatcaggtagcagaccagcagatgccgctgtataatcttctaccgaagatcttatgtcgtgtggttaatgttcagttgaaggctgaaccagatactgatgaggtgtttgcgcaagtgactctgcttcctgagcacaaccaagatgagagtgtgttggagaaggagcctcctccacctccaccaccgcgatttcatgtacattcattttgtaaaaccctgactgcttcggataccagtactcatggtggattttcggttcttagaagacatgcagatgaatgtcttccacctttggatatgtcaaggcagcctccaacacaggaattggttgccaaggatttgcatggaaatgaatggcgtttccgacacatttttcggggccaaccacggaggcacttgcttcagagtggatggagcgtgtttgttagctccaaaaggcttgttgcgggtgatgcgtttatatttctaagaggtgagaatggagaacttcgagttggtgttagacgtgcaatgagacagcagggtaatgttccatcatctgtcatatccagccacagcatgcatcttggggtgcttgctacagcatggcatgctgtttcaacggggaccctgttcactgtttattacaagccaaggacaagtcctgcagagttcattgtcccctttgatcaatacatggagtctgtcaagaataattattccatagggatgaggtttaaaatgagatttgaaggagaagaagctcctgagcaaagatttactggcactattgttggaattgaagatgccgatcccgggaggtggaagaattctaaatggaggtgccttaaggtgagatgggatgaaacttctaccatgcctcggccagagagagtttcaccatggaaaattgagcctgctctagcacctcctgcactaaatcctcttccattgcccaggcctaaaaggcctcgagcaaacatggtgccctcatcccctgactcctcagttcttactagagatgaccctccatcagcaagtggattttcaagggtcttgcaaggtcaagaattctcgaccttgagaggcacttttgcagagagcaatgagtccaatgctgctgaaaagtctgttatgtggccatcctcagcagatgatgagaagatcgatgtgttatctacttcaagaagatttggatcagagaggtggatgtcctctgcgaggcatgaaccaacctgcacagatttgctatctggctttgggacaaattctgattcattccatgggtttggtgccccgtttgttgaccaaactgccgtggctgctaatccaacgaagaaacacttgtcagatcaagggcagtttaacttgcttgccagcccgtggtccataatgtcctcgggtctcttgctaaagttgtcagagtcaaatacaaaggttccagtacaaggcagcgatgtaacatatcaagcacgggcaaatgtgtttagtgagtatcctgtgcttcaaggtcatagagttgagcagtcgcataaaaactggatgatgcatcccccgccatctcattttgataatcatgctaattcgagagagttaatgcccaaacctgttttgatgcaagaacatgattctggaaaatccctggaaggaaactgcaagctctttgggattcctttgaaaattagtaaacctgttgcaccagaggcagcagggaccacaatcacgatgaacgaaccactgagtcatatccaacctgtgagtcaccaacttacatttgaatctgatcagaagtcagaacaatccaaaggttcgaagatgactgatgaaaatgaaaacgagaaaccattccaagctggtcatttgcgaacaaaggacaaccatggaaaagcacaaaatggctcaaccaggagttgtacgaaggttcacaagcaggggattgcacttggtaggtctgttgatcttgccaagttcaataactatgatgagttgattgctgaattggacaggctgtttgaatttaatggtgaattaatggctccccaaaagaattggctgattgtgtacacagacgatgaggatgatatgatgcttgttggagatgatccctggcaggaatttgttggcatggttaggaagatagttatttacaccaaagaggaggcacagaagattaaaccaggcgccttgaattcaaagggcgttgagaatccaatggatatggagggtgaggatgatgccaaggaagccaaacatctgccacttccttcagcatgtagccctatgaattgttag

SEQ ID NO: 114 - protein, 845 aa, Populus balsamifera subsp. trichocarpa
  misc_feature: Ceres ANNOT ID no.1527370
  misc_feature: Bit score of 2089.3 for hmm based on sequences of FIGURE 5.
  misc_feature (157)..(262): Pfam Name: B3 Pfam Description: B3 DNA binding domain
  misc_feature (284)..(366): Pfam Name: Auxin_resp Pfam Description: Auxin response factor
  misc_feature: Is Acted Upon By Ceres SEEDLINE ID no. ME00572 at SEQ ID NO. 111
MASSEISAKANSGNIRGGGESFTSGYSEAMEGQKNHSTHPSSARVVDAETALYNELWHACAGPLVTVPREGDRVFYFPQGHIEQVEASTNQVADQQMPLYNLLPKILCRVVNVQLKAEPDTDEVFAQVTLLPEHNQDESVLEKEPPPPPPPRFHVHSFCKTLTASDTSTHGGFSVLRRHADECLPPLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAVSTGTLFTVYYKPRTSPAEFIVPFDQYMESVKNNYSIGMRFKMRFEGEEAPEQRFTGTIVGIEDADPGRWKNSKWRCLKVRWDETSTMPRPERVSPWKIEPALAPPALNPLPLPRPKRPRANMVPSSPDSSVLTRDDPPSASGFSRVLQGQEFSTLRGTFAESNESNAAEKSVMWPSSADDEKIDVLSTSRRFGSERWMSSARHEPTCTDLLSGFGTNSDSFHGFGAPFVDQTAVAANPTKKHLSDQGQFNLLASPWSIMSSGLLLKLSESNTKVPVQGSDVTYQARANVFSEYPVLQGHRVEQSHKNWMMHPPPSHFDNHANSRELMPKPVLMQEHDSGKSLEGNCKLFGIPLKISKPVAPEAAGTTITMNEPLSHIQPVSHQLTFESDQKSEQSKGSKMTDENENEKPFQAGHLRTKDNHGKAQNGSTRSCTKVHKQGIALGRSVDLAKFNNYDELIAELDRLFEFNGELMAPQKNWLIVYTDDEDDMMLVGDDPWQEFVGMVRKIVIYTKEEAQKIKPGALNSKGVENPMDMEGEDDAKEAKHLPLPSACSPMNC

SEQ ID NO: 115 - DNA, 2637 bp, Populus balsamifera subsp. trichocarpa
  misc_feature: Ceres ANNOT ID no.1473961
  misc_feature: Encodes the peptide sequence at SEQ ID NO. 116
atggcttcttcagagatttcagcgaaagctaacagtggaaacattagaggaggaggagagagcttcacttctggttacagtgaagccatggaagggcagaaaaatcattctactcatccaagttcagctagagttgtagatgctgaaacggcgctgtataatgagctatggcatgcttgtgctggtcctttagtgactgtacctcgtgaaggagatcgtgtgttttatttccctcaaggacatatagagcaggtggaggcatcaacgaatcaggtagcagaccagcagatgccgctgtataatcttctaccgaagatcttatgtcgtgtggttaatgttcagttgaaggctgaaccagatactgatgaggtgtttgcgcaagtgactctgcttcctgagcacaaccaagatgagagtgtgttggagaaggagcctcctccacctccaccaccgcgatttcatgtacattcattttgtaaaaccctgactgcttcggataccagtactcatggtggattttcggttcttagaagacatgcagatgaatgtcttccacctttggatatgtcaaggcagcctccaacacaggaattggttgccaaggatttgcatggaaatgaatggcgtttccgacacatttttcggggtaatcatctcatactcgaacaatcaacttgcattcaagatgccagttgcttaatatgcacaatgatttcaatgccaggccaaccacggaggcacttgcttcagagtggatggagcgtgtttgttagctccaaaaggcttgttgcgggtgatgcgtttatatttctaagaggtgagaatggagaacttcgagttggtgttagacgtgcaatgagacagcagggtaatgttccatcatctgtcatatccagccacagcatgcatcttggggtgcttgctacagcatggcatgctgtttcaacggggaccctgttcactgtttattacaagccaaggacaagtcctgcagagttcattgtcccctttgatcaatacatggagtctgtcaagaataattattccatagggatgaggtttaaaatgagatttgaaggagaagaagctcctgagcaaagatttactggcactattgttggaattgaagatgccgatcccgggaggtggaagaattctaaatggaggtgccttaaggtgagatgggatgaaacttctaccatgcctcggccagagagagtttcaccatggaaaattgagcctgctctagcacctcctgcactaaatcctcttccattgcccaggcctaaaaggcctcgagcaaacatggtgccctcatcccctgactcctcagttcttactagagatggttcattcaaagtaactgcagaccctccatcagcaagtggattttcaagggtcttgcaaggtcaagaattctcgaccttgagaggcacttttgcagagagcaatgagtccaatgctgctgaaaagtctgttatgtggccatcctcagcagatgatgagaagatcgatgtgttatctacttcaagaagatttggatcagagaggtggatgtcctctgcgaggcatgaaccaacctgcacagatttgctatctggctttgggacaaattctgattcattccatgggtttggtgccccgtttgttgaccaaactgccgtggctgctaatccaacgaagaaacacttgtcagatcaagggcagtttaacttgcttgccagcccgtggtccataatgtcctcgggtctcttgctaaagttgtcagagtcaaatacaaaggttccagtacaaggcagcgatgtaacatatcaagcacgggcaaatgtgtttagtgagtatcctgtgcttcaaggtcatagagttgagcagtcgcataaaaactggatgatgcatcccccgccatctcattttgataatcatgctaattcgagagagttaatgcccaaacctgttttgatgcaagaacatgattctggaaaatccctggaaggaaactgcaagctctttgggattcctttgaaaattagtaaacctgttgcaccagaggcagcagggaccacaatcacgatgaacgaaccactgagtcatatccaacctgtgagtcaccaacttacatttgaatctgatcagaagtcagaacaatccaaaggttcgaagatgactgatgaaaatgaaaacgagaaaccattccaagctggtcatttgcgaacaaaggacaaccatggaaaagcacaaaatggctcaaccaggagttgtacgaaggttcacaagcaggggattgcacttggtaggtctgttgatcttgccaagttcaataactatgatgagttgattgctgaattggacaggctgtttgaatttaatggtgaattaatggctccccaaaagaattggctgattgtgtacacagacgatgaggatgatatgatgcttgttggagatgatccctggcaggaatttgttggcatggttaggaagatagttatttacaccaaagaggaggcacagaagattaaaccaggcgccttgaattcaaagggcgttgagaatccaatggatatggagggtgaggatgatgccaaggaagccaaacatctgccacttccttcagcatgtagccctatgaattgttag

SEQ ID NO: 116 - protein, 852 aa, Populus balsamifera subsp. trichocarpa
  misc_feature: Ceres ANNOT ID no.1473961
  misc_feature: Bit score of 2110.3 for hmm based on sequences of FIGURE 5.
  misc_feature (157)..(262): Pfam Name: B3 Pfam Description: B3 DNA binding domain
  misc_feature (284)..(366): Pfam Name: Auxin_resp Pfam Description: Auxin response factor
  misc_feature: Is Acted Upon By Ceres SEEDLINE ID no. ME00572 at SEQ ID NO. 111
MASSEISAKANSGNIRGGGESFTSGYSEAMEGQKNHSTHPSSARVVDAETALYNELWHACAGPLVTVPREGDRVFYFPQGHIEQVEASTNQVADQQMPLYNLLPKILCRVVNVQLKAEPDTDEVFAQVTLLPEHNQDESVLEKEPPPPPPPRFHVHSFCKTLTASDTSTHGGFSVLRRHADECLPPLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAVSTGTLFTVYYKPRTSPAEFIVPFDQYMESVKNNYSIGMRFKMRFEGEEAPEQRFTGTIVGIEDADPGRWKNSKWRCLKVRWDETSTMPRPERVSPWKIEPALAPPALNPLPLPRPKRPRANMVPSSPDSSVLTRDGSFKVTADPPSASGFSRVLQGQEFSTLRGTFAESNESNAAEKSVMWPSSADDEKIDVLSTSRRFGSERWMSSARHEPTCTDLLSGFGTNSDSFHGFGAPFVDQTAVAANPTKKHLSDQGQFNLLASPWSIMSSGLLLKLSESNTKVPVQGSDVTYQARANVFSEYPVLQGHRVEQSHKNWMMHPPPSHFDNHANSRELMPKPVLMQEHDSGKSLEGNCKLFGIPLKISKPVAPEAAGTTITMNEPLSHIQPVSHQLTFESDQKSEQSKGSKMTDENENEKPFQAGHLRTKDNHGKAQNGSTRSCTKVHKQGIALGRSVDLAKFNNYDELIAELDRLFEFNGELMAPQKNWLIVYTDDEDDMMLVGDDPWQEFVGMVRKIVIYTKEEAQKIKPGALNSKGVENPMDMEGEDDAKEAKHLPLPSACSPMNC

SEQ ID NO: 117 - protein, 859 aa, Arabidopsis thaliana
  misc_feature: Public GI ID no.62319853
  misc_feature: Bit score of 2155.3 for hmm based on sequences of FIGURE 5.
  misc_feature (163)..(268): Pfam Name: B3 Pfam Description: B3 DNA binding domain
  misc_feature (290)..(372): Pfam Name: Auxin_resp Pfam Description: Auxin response factor
  misc_feature: Is Acted Upon By Ceres SEEDLINE ID no. ME00572 at SEQ ID NO. 111
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTVSCRSEEEAVVGEGSDAKDAKSASNPSLSSAGNS

SEQ ID NO: 118 - protein, 859 aa, Arabidopsis thaliana
  misc_feature: Public GI ID no.62319903
  misc_feature: Bit score of 2157 for hmm based on sequences of FIGURE 5.
  misc_feature (163)..(268): Pfam Name: B3 Pfam Description: B3 DNA binding domain
  misc_feature (290)..(372): Pfam Name: Auxin_resp Pfam Description: Auxin response factor
  misc_feature: Is Acted Upon By Ceres SEEDLINE ID no. ME00572 at SEQ ID NO. 111
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPALNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 119 - protein, 848 aa, Brassica napus
  misc_feature: Public GI ID no.47716275
  misc_feature: Bit score of 2099.9 for hmm based on sequences of FIGURE 5.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature: Is Acted Upon By Ceres SEEDLINE ID no. ME00572 at SEQ ID NO. 111
MASSEVSMKGNRGRGENFSSAGYSDPTVAGEAQKTQSNRSVAAERVVDPEAALYRELWHACAGPLVTVPRQDDRVFYFPQGHIEQVEASTNQAAEQQMPLYDLPSKILCRVINVDLKAEADTDEVYAQITLLPEPVQDENSIEKEAPPPPPPRFQVHSFCKTLTASDTSTHGGFSVLRRHADECLPPLDMSRQPPTQELVAKDLHASEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYTESVKINYSIGMRFKMRFEGEEAPEQRFTGTIVGIEDSDPTRWAKSKWRSLKVRWDETTSIPRPDRVSPWKIEPALSPPALSPVPMPRPKRPRSNLASSTPDSSMRIREGSSKANMDPLPASGLSRVLQGQEYPTLRTKHVESVECDAPENSVVWQSSTDDDKVDVISASRRYENWISSGRHGPTCTDLLSGFGTNIEPPHGHQIPFYDRLSSPPSVAARKILSDQDGKFEYLANQWMMHSGLSLKLHESPKVPAASDASFQGIGNPNYGEYALPRAVTTENAAGNWPIRPRALNYFEEAVHAQAREHVTKRPAVVQEEAAKPRDGNCRLFGIPLVNNVNGTDTTLSQRNNLNDPAGPTQMASPKVQDLSDQSKGSKSTNDHREQGRPFPVSKPHPKDVQTKTNSCRSCTKVQKQGIALGRSVDLSKFQNYEELVTELDRLFEFNGELMAPKKDWLIVYTDDENDMMLVGDDPWQEFCCMVRKIFIYTKEEVRKMNPGTLCCRNEEEPVVGEGSDAKDAKSASNPSLSSAGNS

SEQ ID NO: 120 - protein, 853 aa, Oryza sativa subsp. indica
  misc_feature: Public GI ID no.125534572
  misc_feature: Bit score of 2096 for hmm based on sequences of FIGURE 5.
  misc_feature (148)..(253): Pfam Name: B3 Pfam Description: B3 DNA binding domain
  misc_feature (275)..(357): Pfam Name: Auxin_resp Pfam Description: Auxin response factor
  misc_feature: Is Acted Upon By Ceres SEEDLINE ID no. ME00572 at SEQ ID NO. 111
MATAEVGGGGGEGDAAAAAVARAGGGGGGGGGGGEDALFTELWSACAGPLVTVPRVGEKVFYFPQGHIEQVEASTNQVGEQRMQLYNLPWKILCEVMNVELKAEPDTDEVYAQLTLLPELKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGWMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 121 - protein, 857 aa, Oryza sativa subsp. indica
  misc_feature: Public GI ID no.26251300
  misc_feature: Bit score of 2070.6 for hmm based on sequences of FIGURE 5.
  misc_feature (147)..(252): Pfam Name: B3 Pfam Description: B3 DNA binding domain
  misc_feature (274)..(356): Pfam Name: Auxin_resp Pfam Description: Auxin response factor
  misc_feature: Is Acted Upon By Ceres SEEDLINE ID no. ME00572 at SEQ ID NO. 111
MATAEVGGGGGEGDAAAAAVARAGGGGGGGGGGEDALFTELWSACAGPLVTVPRVGEKEFYFPQGHIEQVEASTNQVGEQRMQLYNLPWKILCEVMNVELKAEPDTDEVYAQLTLLPELKRQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKRNYSIGMRFKMRFESEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQTPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGLMMPNSHMDDTQPRLIKPKPLVVAHGDVQKAKGASCKLFGIHLDSPAKSEPSKSPSSVVYDGTPQTPGATEWRRPDVTEVEKCSDPSKAMKPLDTPQPDSVPEKPSSQQASSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNLRSEDSHANSMERGSVGREMRGCLSTSSLNSENC

SEQ ID NO: 122 - protein, 853 aa, Oryza sativa subsp. indica
  misc_feature: Public GI ID no.125528952
  misc_feature: Bit score of 1880.3 for hmm based on sequences of FIGURE 5.
  misc_feature (123)..(228): Pfam Name: B3 Pfam Description: B3 DNA binding domain
  misc_feature (250)..(331): Pfam Name: Auxin_resp Pfam Description: Auxin response factor
  misc_feature: Is Acted Upon By Ceres SEEDLINE ID no. ME00572 at SEQ ID NO. 111
MAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKHMKFFLLVVDMLKFSFCKFLAKSQFYPLCGMVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGSVKRDDTRDGGVLQKAASASVLSILRYSS

SEQ ID NO: 123 - protein, 808 aa, Oryza sativa subsp. japonica
  misc_feature: Public GI ID no.115441981
  misc_feature: Bit score of 1951.3 for hmm based on sequences of FIGURE 5.
  misc_feature (128)..(233): Pfam Name: B3 Pfam Description: B3 DNA binding domain
  misc_feature (255)..(336): Pfam Name: Auxin_resp Pfam Description: Auxin response factor
  misc_feature: Is Acted Upon By Ceres SEEDLINE ID no. ME00572 at SEQ ID NO. 111
MPPAAMAPPPPPQGSSTGDPLYDELWHACAGPLVTVPRVGDLVFYFPQGHIEQVEASMNQVADSQMRLYDLPSKLLCRVLNVELKAEQDTDEVYAQVMLMPEPEQNEMAVEKTTPTSGPVQARPPVRSFCKTLTASDTSTHGGFSVLRRHADECLPPLDMTQSPPTQELVAKDLHSMDWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSVGMRFRMRFEGEEAPEQRFTGTIIGSENLDPVWPESSWRSLKVRWDEPSTIPRPDRVSPWKIEPASSPPVNPLPLSRVKRPRPNAPPASPESPILTKEAATKVDTDPAQAQRSQNSTVLQGQEQMTLRSNLTESNDSDVTAHKPMMWSPSPNAAKAHPLTFQQRPPMDNWMQLGRRETDFKDVRSGSQSFGDSPGFFMQNFDEAPNRLTSFKNQFQDQGSARHFSDPYYYVSPQPSLTVESSTQMHTDSKELHFWNGQSTVYGNSRDRPQNFRFEQNSSSWLNQSFARPEQPRVIRPHASIAPVELEKTEGSGFKIFGFKVDTTNAPNNHLSSPMAATHEPMLQTPSSLNQLQPVQTDCIPEVSVSTAGTATENEKSGQQAQQSSKDVQSKTQVASTRSCTKVHKQGVALGRSVDLSKFSNYDELKAELDKMFEFDGELVSSNKNWQIVYTDNEGDMMLVGDDPWEEFCSIVRKIYIYTKEEVQKMNSKSNAPRKDDSSENEKGHLPMPNKSDN

SEQ ID NO: 124 - protein, 836 aa, Oryza sativa subsp. japonica
  misc_feature: Public GI ID no.23893346
  misc_feature: Bit score of 2065.7 for hmm based on sequences of FIGURE 5.
  misc_feature (131)..(236): Pfam Name: B3 Pfam Description: B3 DNA binding domain
  misc_feature (258)..(340): Pfam Name: Auxin_resp Pfam Description: Auxin response factor
  misc_feature: Is Acted Upon By Ceres SEEDLINE ID no. ME00572 at SEQ ID NO. 111
MATAEVGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFWSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 125 - protein, 852 aa, Oryza sativa subsp. japonica
  misc_feature: Public GI ID no.115485689
  misc_feature: Bit score of 2092.5 for hmm based on sequences of FIGURE 5.
  misc_feature (147)..(252): Pfam Name: B3 Pfam Description: B3 DNA binding domain
  misc_feature (274)..(356): Pfam Name: Auxin_resp Pfam Description: Auxin response factor
  misc_feature: Is Acted Upon By Ceres SEEDLINE ID no. ME00572 at SEQ ID NO. 111
MATAEVGGGGGEGDAAAAAVARGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 126 - protein, 853 aa, Oryza sativa subsp. japonica
  misc_feature: Public GI ID no.108864435
  misc_feature: Bit score of 2094.3 for hmm based on sequences of FIGURE 5.
  misc_feature (148)..(253): Pfam Name: B3 Pfam Description: B3 DNA binding domain
  misc_feature (275)..(357): Pfam Name: Auxin_resp Pfam Description: Auxin response factor
  misc_feature: Is Acted Upon By Ceres SEEDLINE ID no. ME00572 at SEQ ID NO. 111
MATAEVGGGGGEGDAAAAAVARAGGGGGGGGGGGEDALFTELWSACAGPLVTVPRVGEKVFYFPQGHIEQVEASTNQVGEQRMQLYNLPWKILCEVMNVELKAEPDTDEVYAQLTLLPESKQQEDNGSTEEEVPSAPAAGHVRPRVHSFCKTLTASDTSTHGGFSVLRRHADECLPPLDMSRQPPTQELVAKDLHGVEWRFRHIFRGQPRRHLLQSGWSVFVSAKRLVAGDAFIFLRGENGELRVGVRRAMRQQTNVPSSVISSHSMHLGVLATAWHAVNTGTMFTVYYKPRTSPAEFVVPYDRYMESLKQNYSIGMRFKMRFEGEEAPEQRFTGTIVGMGDSDPAGWPESKWRSLKVRWDEASSIPRPERVSPWQIEPAVSPPPVNPLPVPRTKRLRPNATALPADSSAIAKEAATKVVVESEPNGTQRTFQTQENATPKSGFGNSSELESAQKSIMRPSGFDREKNNTPIQWKLGSDGRMQMSKPESYSEMLSGFQPPKDVQIPQGFCSLPEQITAGHSNFWHTVNAQYQDQQSNHNMFPSSWSFMPPNTRLGLNKQNYSMIQEAGVLSQRPGNTKFGNGVYAALPGRGTEQYSGGWFGHMMPNSHMDDTQPRLIKPKPLVVAHGDVQKAKGASCKLFGIHLDSPAKSEPLKSPSSVVYDGTPQTPGATEWRRPDVTEVEKCSDPSKAMKPLDTPQPDSVPEKPSSQQASRNMSCKSQGVSTRSCKKVHKQGIALGRSVDLTKFNGYEELIAELDDMFDFNGELKGPKKEWMVVYTDNEGDMMLVGDDPWIEFCDMVHKIFIYTREEVQRMNPGTLNSRSEDSHANSMERGSVGREMRGCLSTSSLNSENC

SEQ ID NO: 127 - protein, 719 aa, Oryza sativa subsp. japonica
  misc_feature: Public GI ID no.50511471
  misc_feature: Bit score of 1618.2 for hmm based on sequences of FIGURE 5.
  misc_feature (141)..(246): Pfam Name: B3 Pfam Description: B3 DNA binding domain
  misc_feature (268)..(349): Pfam Name: Auxin_resp Pfam Description: Auxin response factor
  misc_feature: Is Acted Upon By Ceres SEEDLINE ID no. ME00572 at SEQ ID NO. 111
MTGIDLNTVEEDEEEAAEEVAANGSSPAPARAGAVCLELWHACAGPVAPLPRKGGVVVYLPQGHLEHLGDAPAAAAAAAAVPPHVFCRVVDVTLLADAATDEVYAQLSLVPEKEEVARRADDGEGEDGDGMKQRFARMPHMFCKTLTASDTSTHGGFSVPRRAAEDCFPPLDYSQQRPSQELVAKDLHSTEWRFRHIYRGQPRRHLLTTGWSAFVNKKKLVSGDAVLFLRGDDGELRLGVRRAAQLKNGSAFPALYNQCSNLGTLANVAHAVATESVFNIYYNPRLSQSEFIVPYWKFMKSLSQPFSVGLRFKMRYESEDATERRYTGIITGSGDTDPMWHGSKWKCLLVRWDDDAEFRRPNRVSPWEIELTSSVSGSHLSTPHSKRLKPCLPHVNPEYMVPRGGGCPDFAESAQFHKVLQGQELLGFKSHGGTAAATSQPCEARHLQYIDERSCSSDASNSILGVPRLGDRAPLGNPGFSYHCSGFGESHRLQKVLQGQELFRPYRGTLVDASMGSNGFHQQDSPRAPGVVNKWQAQLHGRAAFHGPPALALPSQSSSPPSVLMFQQANSKMPRLEFGHGQLDKHENDRRVRFGPSEGIERREQRIPLQPYPTSGEVIDGQVTVEKSHSPGRHGKDGPDNKAVGTNSCKIFGISLTEKVPAREELDDGDANYSLQSLKQVPKSLGNSCATMVAEYQGDGGTDDSDIFILDVGVGALIM

SEQ ID NO: 128 - protein, 608 aa, Arabidopsis thaliana
  misc_feature: Ceres LOCUS ID no. At2g33860
  misc_feature: Bit score of 1320.6 for hmm based on sequences of FIGURE 5.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature: Is Acted Upon By Ceres SEEDLINE ID no. ME00572 at SEQ ID NO. 111
MGGLIDLNVMETEEDETQTQTPSSASGSVSPTSSSSASVSVVSSNSAGGGVCLELWHACAGPLISLPKRGSLVLYFPQGHLEQAPDFSAAIYGLPPHVFCRILDVKLHAETTTDEVYAQVSLLPESEDIERKVREGIIDVDGGEEDYEVLKRSNTPHMFCKTLTASDTSTHGGFSVPRRAAEDCFPPLDYSQPRPSQELLARDLHGLEWRFRHIYRGQPRRHLLTTGWSAFVNKKKLVSGDAVLFLRGDDGKLRLGVRRASQIEGTAALSAQYNQNMNHNNFSEVAHAISTHSVFSISYNPKASWSNFIIPAPKFLKVVDYPFCIGMRFKARVESEDASERRSPGIISGISDLDPIRWPGSKWRCLLVRWDDIVANGHQQRVSPWEIEPSGSISNSGSFVTTGPKRSRIGFSSGKPDIPVSEGIRATDFEESLRFQRVLQGQEIFPGFINTCSDGGAGARRGRFKGTEFGDSYGFHKVLQGQETVPAYSITDHRQQHGLSQRNIWCGPFQNFSTRILPPSVSSSPSSVLLTNSNSPNGRLEDHHGGSGRCRLFGFPLTDETTAVASATAVPCVEGNSMKGASAVQSNHHHSQGRDIYAMRDMLLDIAL

SEQ ID NO: 129 - DNA, 1995 bp, Populus balsamifera subsp. trichocarpa
  misc_feature: Ceres ANNOT ID no.1536494
  misc_feature: Encodes the peptide sequence at SEQ ID NO. 130
atggtgggtatgatagatctcaacactattgaagaagatgaaactacaccgtcttgtgggtctttatcttctccatcatcatcctctgctgcttctgctttgagtgcttctggctctggttctagtacctcttctgtttgtttggagctttggcatgcttgtgctggcccactaatatctttgccaaagagagggagtgttgttgtgtatttccctcaaggccacttggaacaactccctgatttgcctcttgcagtttatgatctcccttctcatgtcttctgtcgagttgttgatgtcaagctccatgtctccctggttcctgagagtgaggaaattgagcagaagttgagggaggggatatttgagggggatggtgaggaggaggatggtgaagccactgtgaagatgacaacaccccatatgttctgtaagaccctaactgcttctgacactagcactcatggaggcttttcagtccctcgtcgagctgctgaggactgcttccctcctctggattatactcaacaaaggccttcacaagagcttgtggcaaaggatcttcatggctctgagtggaagtttcgacatatctacaggggtcagccacggaggcatttgctcactactggatggagtgcgtttgtcaataagaaaaaacttgtctctggggatgccgttctctttctcaggggtgaggatggggaattgagactgggagttcgaagagcagcacaagttaaatgtggccctacatttccagctcaatggaatcatcagctgaatcagatctctcctggggatgtagctaatgctatttctactagaagttttttccacatttactacaatccaagggccagctcatcagagttcataataccttttaataaattcttgaagagccttgatcaatccttctcttctggaatgagattcaaaatgcgttttgaaacagaagatgcagcagagagaagatacactggaataataactggagtcagtgagctagatcctgctagatggcctggttcaaaatggaaatgcctgttggtaaggtgggatgatagggaggctaacaggctcagcagggtttctccttgggaagttgagccttctggttctggttctatttccagctccaataactttatggcacctggtttgaagaggagcaggtctggattgccttcatcaaaggcagaatttccaattcctgatgggataggagcaccaggctttagggaatcttcaaggtcccaggaggtcttgcaaggaagtggtatcagagactcgattgccacttcaaataactcctacaagggcataggctttaacgaatcttatagattccataaggtcttccaaggtcaagaaatttttccaagctcaccatatggaagaatcccaaatgctaatgaggctcgtgaaaattgtagtcttggattctctgatggtgtccaaaggtcaagctcaagaaatggatggtctacattgatgcagggctataatactcaaattcgacctcctgcacaagtatcatcaccatcttcggtgttaatgtttcaacatgccagcaatccagttccaaagcgatcttccaattttaatttcaatgatcatgtgcagcagacagctaccacccgaagttggttttgtggtcctgaaatgcagggggggaatttcaagttgtctgcacattctgagcccagtgtaaaaagagacggccaatggagcaatagtccttttggtctgtcccatgagcatcttcaacatggcgtttcacaacctattgtagctcaatcagcctttaggggtagtcaagatttggtgtcgtgcaaaagcagctgcagactctttggtttctcattgactgaggataaatgccttgttaataaggaggacaatatgaccttaataacatctccattgaatcctggatcctcctttctgcctcgcgccggagagcacttccatcaaagcctccagcaataa

SEQ ID NO: 130 - protein, 664 aa, Populus balsamifera subsp. trichocarpa
  misc_feature: Ceres ANNOT ID no.1536494
  misc_feature: Bit score of 802.9 for hmm based on sequences of FIGURE 5.
  misc_feature (142)..(247): Pfam Name: B3 Pfam Description: B3 DNA binding domain
  misc_feature (269)..(351): Pfam Name: Auxin_resp Pfam Description: Auxin response factor
  misc_feature: Is Acted Upon By Ceres SEEDLINE ID no. ME00572 at SEQ ID NO. 111
MVGMIDLNTIEEDETTPSCGSLSSPSSSSAASALSASGSGSSTSSVCLELWHACAGPLISLPKRGSVVVYFPQGHLEQLPDLPLAVYDLPSHVFCRVVDVKLHVSLVPESEEIEQKLREGIFEGDGEEEDGEATVKMTTPHMFCKTLTASDTSTHGGFSVPRRAAEDCFPPLDYTQQRPSQELVAKDLHGSEWKFRHIYRGQPRRHLLTTGWSAFVNKKKLVSGDAVLFLRGEDGELRLGVRRAAQVKCGPTFPAQWNHQLNQISPGDVANAISTRSFFHIYYNPRASSSEFIIPFNKFLKSLDQSFSSGMRFKMRFETEDAAERRYTGIITGVSELDPARWPGSKWKCLLVRWDDREANRLSRVSPWEVEPSGSGSISSSNNFMAPGLKRSRSGLPSSKAEFPIPDGIGAPGFRESSRSQEVLQGSGIRDSIATSNNSYKGIGFNESYRFHKVFQGQEIFPSSPYGRIPNANEARENCSLGFSDGVQRSSSRNGWSTLMQGYNTQIRPPAQVSSPSSVLMFQHASNPVPKRSSNFNFNDHVQQTATTRSWFCGPEMQGGNFKLSAHSEPSVKRDGQWSNSPFGLSHEHLQHGVSQPIVAQSAFRGSQDLVSCKSSCRLFGFSLTEDKCLVNKEDNMTLITSPLNPGSSFLPRAGEHFHQSLQQ

SEQ ID NO: 131 - protein, 608 aa, Arabidopsis thaliana
  misc_feature: Public GI ID no.2245390
  misc_feature: Bit score of 1323.9 for hmm based on sequences of FIGURE 5.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature: Is Acted Upon By Ceres SEEDLINE ID no. ME00572 at SEQ ID NO. 111
MGGLIDLNVMETEEDETQTQTPSSASGSVSPTSSSSASVSVVSSNSAGGGVCLELWHACAGPLISLPKRGSLVLYFPQGHLEQAPDFSAAIYGLPPHVFCRILDVKLHAETTTDEVYAQVSLLPESEDIERKVREGIIDVDGGEEDYEVLKRSNTPHMFCKTLTASDTSTHGGFSVPRRAAEDCFPPLDYSQPRPSQELLARDLHGLEWRFRHIYRGQPRRHLLTTGWSAFVNKKKLVSGDAVLFLRGDDGKLRLGVRRASQIEGTAALSAQYNQNMNHNNFSEVAHAISTHSVFSISYNPKASWSNFIIPAPKFLKVVDYPFCIGMRFKARVESEDASERRSPGIISGISDLDPIRWPGSKWRCLLVRWDDIVANGHQQRVSPWEIEPSGSISNSGSFVTTGPKRSRIGFSSGKPDIPVSEGIRATDFEESLRFQRVLQGQEIFPGFINTCSDGGAGARRGRFKGTEFGDSYGFHKVLQGQETVPAYSITDHRQQHGLSQRNIWCGPFQNFSTRILPPSVSSSPSSVLFTNSNSPNGRLEDHHGGSGRCRLFGFPLTDETTAVASATAVPCVEGNSMKGASAVQSNHHHSQGRDIYAMRDMLLDIAL

SEQ ID NO: 132 - protein, 608 aa, Arabidopsis thaliana
  misc_feature: Public GI ID no.3228517
  misc_feature: Bit score of 1320.4 for hmm based on sequences of FIGURE 5.
  misc_feature (158)..(263): Pfam Name: B3 Pfam Description: B3 DNA binding domain
  misc_feature (285)..(367): Pfam Name: Auxin_resp Pfam Description: Auxin response factor
  misc_feature: Is Acted Upon By Ceres SEEDLINE ID no. ME00572 at SEQ ID NO. 111
MGGLIDLNVMETEEDETQTQTPSSASGSVSPTSSSSASVSVVSSNSAGGGVCLELWHACAGPLISLPKRGSLVLYFPQGHLEQAPDFSAAIYGLPPHVFCRILDVKLHAETTTDEVYAQVSLLPESEDIERKVREGIIDVDGGEEDYEVLKRSNTPHMFCKTLTASDTSTHGGFSVPRRAAEDCFPPLDYSQPRPSQELLARDLHGLEWRFRHIYRGQPRRHLLTTGWSAFVNKKKLVSGDAVLFLRGDDGKLRLGVRRASQIEGTAALSAQYNQNMNHNNFSEVAHAISTHSVFSISYNPKASWSNFIIPAPKFLKVVDYPFCIGMRFKARVESEDASERRSPGIISGISDLDPIRWPGSKWRCLLVRWDDIVANGHQQRVSPWEIEPSGSISNSGSFVTTGPKRSRIGISSGKPDIPVSEGIRATDFEESLRFQRVLQGQEIFPGFINTCSDGGAGARRGRFKGTEFGDSYGFHKVLQGQETVPAYSITDHRQQHGLSQRNIWCGPFQNFSTRILPPSVSSSPSSVLLTNSNSPNGRLEDHHGGSGRCRLFGFPLTDETTAVASATAVPCVEGNSMKGASAVQSNHHHSQGRDIYAMRDMLLDIAL

SEQ ID NO: 133 - DNA, 2420 bp, Triticum aestivum
  misc_feature: Ceres CLONE ID no.827306
  misc_feature: Encodes the peptide sequence at SEQ ID NO. 134
acgcctcacgcctcacgcccgcgtcataaaatcgtgggcgactcgtgtcccagtcccagcaggctcagccacagcccacagcgacgcggcagcggcagcaggaacagcaacagcgaccttgcttcccgcgcgcggcagccgagggaggggaggaggagatcgaggggggcaagcggggcagggcggcatggggacggggggctagaacaaggagatggctgcagagcgacgccctcgggggcattaatggggccctccctctgctccacatcctgctgctcccacatcctccccgcggccgcggttgattcctcgcccgcctacttttaaccgcgcccccccttttccggacgggacggctgggctgtgggcgggcgccatgggcatcgatctcaacgcggcggacgagcctggcaaggcggcggcggtgtcggtgtgccgggacctgtggcacgcctgcgcggggccggtcgtggcgctgccgcgccggggcagcgccgtcgtctacctgccgcaggcgcacctcgccgcggccggcggcgggggggacgtgccggtggccctgccgccgcatgtggcgtgccgcgtggtggacgtcgagctatgcgcggatccggcgaccgacgaggtctacgcgcggctggctatggtggcggagggcgagatctttgagaagaacatgggaggtggtcggtttgaaggggaagatgacatggaagatggcgatggagaaaggaagtcccggatgctgcacatgttctgcaagacactaacagcctctgacacaagcacacacgggggattctctgttccccgccgtgctgccgaggactgtttccccccactggactaccagcagatcaggccttcccaagagcttgttgcaaaggatttgcatggagcgaagtggaggttccgccatatctatagaggtcaaccacgtaggcatcttttaacgactggatggagttcatttgtcaataaaaagaaacttgtctctggggatgcagtcttatttctccgtggtgatgatggtgaactacgacttggtgtaaggagagccattcagcttaaaaatgaggcccttctgaaagctttcaatagcaacagctcaaagatacacacactgtctgctgtggctaattccttgaaacatagaagtgtttttcacatctgttacaatccaagggctgctgcatccgaatttattgttccgtactggaagttcctgaagagcctgaatcgtccattttgtattggaatgaggtttaagattcagtatgggagtgaagatgttaatgagaggcgatctggaatgattacaggtattaatgaagtagaccccattaggtggactggttcaaaatggaaaagcctgcaggtaagatgggaggatggcaccgactgtaatagccaaaatagactatcgccatgggatatcgagatagttggtggctcggtctctattgcccagtctctgtcagcatccagttctaaacgaactaaactgtgccctcagggcaatgtggacgtcccaactctgtatgggaatgttcgtccggactccgtgggagctgataaactccccagggtcttgcaaggtcaagaattgatgggttctggaactcatcgttttacatgtcctcctcagccaggtggcgccacagaattccggcgttctgatggtacggggttccttactgatacacgaagctgcttgctgagtggtccagcaagcaggcttccacctcaaagctcctatttcgcctaccaacctgtaggcttcggtgaatccgttgggttcccggaggtcttgcaaggtcaagaagtttgtcagacggttcctctgtaccaaggaatggtgtctgatacatgttccgctaaagcgggatacgggatgtacaattacatgcgcacctcgtctgccatgaacggagggttttcatctgcacctcagggttatcctctctccctgtctactccgccccgagcagtggcggcttcgccctcatccgcagcggttccaccacagctttggctggcaagcaagagcaatgaagaagctgcgaatggcagccagcttaacccatttggaattcgaaaggttcctggtgatggtgctgctaagcttggtgatggtgctgctaagcttggatctgatggaaggaaggttgccagaaccagttgcatgcttttcgggttttccttgaccgagaagatgttgccaacggaagaagactctgccaaggaagggaaccatgaagtcgactgtcagaatccgcggatgctagacttgtttggatacaaccgcgccactcccggcactcttcacgccctctgcgccgctcccctgggaatatgatgccactccagttccagtatgatccaagtactttgtagtgctctttctaagaaacttt

SEQ ID NO: 134 - protein, 660 aa, Triticum aestivum
  misc_feature: Ceres CLONE ID no.827306
  misc_feature: Bit score of 1417.6 for hmm based on sequences of FIGURE 5.
  misc_feature (126)..(231): Pfam Name: B3 Pfam Description: B3 DNA binding domain
  misc_feature (253)..(334): Pfam Name: Auxin_resp Pfam Description: Auxin response factor
  misc_feature: Is Acted Upon By Ceres SEEDLINE ID no. ME00572 at SEQ ID NO. 111
MGIDLNAADEPGKAAAVSVCRDLWHACAGPVVALPRRGSAVVYLPQAHLAAAGGGGDVPVALPPHVACRVVDVELCADPATDEVYARLAMVAEGEIFEKNMGGGRFEGEDDMEDGDGERKSRMLHMFCKTLTASDTSTHGGFSVPRRAAEDCFPPLDYQQIRPSQELVAKDLHGAKWRFRHIYRGQPRRHLLTTGWSSFVNKKKLVSGDAVLFLRGDDGELRLGVRRAIQLKNEALLKAFNSNSSKIHTLSAVANSLKHRSVFHICYNPRAAASEFIVPYWKFLKSLNRPFCIGMRFKIQYGSEDVNERRSGMITGINEVDPIRWTGSKWKSLQVRWEDGTDCNSQNRLSPWDIEIVGGSVSIAQSLSASSSKRTKLCPQGNVDVPTLYGNVRPDSVGADKLPRVLQGQELMGSGTHRFTCPPQPGGATEFRRSDGTGFLTDTRSCLLSGPASRLPPQSSYFAYQPVGFGESVGFPEVLQGQEVCQTVPLYQGMVSDTCSAKAGYGMYNYMRTSSAMNGGFSSAPQGYPLSLSTPPRAVAASPSSAAVPPQLWLASKSNEEAANGSQLNPFGIRKVPGDGAAKLGDGAAKLGSDGRKVARTSCMLFGFSLTEKMLPTEEDSAKEGNHEVDCQNPRMLDLFGYNRATPGTLHALCAAPLGI

SEQ ID NO: 135 - DNA, 2339 bp, Zea mays
  misc_feature: Ceres CLONE ID no.1598488
  misc_feature: Encodes the peptide sequence at SEQ ID NO. 136
cctgtacgccgtcccgcttcgcttcggagaggtcgctgcctgccatcaacgttccctcgctggtagagtagaggtagacccaccgacccccagtactagtcgggagagagatggggattgatctcaacgccgtgggggaggacgacccggcgggcgcggtgtgcgcggagctgtggcacgcgtgcgcgggggctggagtggcgctgccgcggcggggcagcgccgtggtgtacctgcctcaggcgcacctcgcggcgggcggctgcgacggtggtgggatgtcggcgccggccccgccgcgcgtgccgccgcacgtggtgtgtcgcgtcgtcgacgtcgagctacgcgcggatgcggccacggacgaggtgtacgcgcggcttgcgctggtggcgatggatacgatgtttggccgaaacatcaatgatggtgaaactgaagagaagaatggcgaggaagaggatggcgacggagaaaagaagcacgcatcacacatgttctgcaagacactcacagcttctgataccagcacacatgggggattctctgttccacggcgagctgcagaggactgctttccacccttggactatgagcagcttaggccttcccaagagcttattgccaaggatttgcatggcatgaaatggaggttccgtcatatctatagaggtcaacctcgaaggcatcttctgacaactggatggagttcatttatcaataagaagaaactagtctcaggggatgcagtcttgtttcttagaggtaatgatggtgagctaagattgggtgtgaggagagcagttcaactgaaaaatgaagctctacttgaagctgtcaactgtactgattcgaagctacttatgctgtctgctgtcgccaattctttggacaacagaagtatatttcacatctgtttcaacccaagggttggtgcatcagaatttattgtgccgtattgcaagttcttgaagagtttgaactatcccttttcagttggaaccagatttaaagttggctgcgagaatgaagatgctaacgagaggtcctttggattgatcataggtattagtgaagttgatcccatacactggcctggatcaaaatggaaatctctcctgataaagtgggatggtgctactaagtacagccaccagaatagagtatctccatgggacatcgagggagttggcagctcagtttcagttactcaccgtctttcctcttctgtttcgaagcgaacaaaactgtgcttccctccaagcgatttggacacgccaattctagatggaaatggtcgtccagactccgtggaaactgaacgtttccacagggtcttgcaaggtcaagaattggtgcactctagtattcacggtgctgcatgctctcattcatcagatagccccagatgtcaaggctcttatggcaggagattctctgctgatgcatggaactgcaagatgaatgatgtaatgagtgggcctcgacacctaaatgccactgggtttgcttaccagcccctaggcttcagtgaatctgtcaaattctcagaggtcttgcaaggtcaagaaatgtctcaggcggttccttccttcatgagatctgctttcaactctggcacgcagaatggcagggttcgaccatttgattatgtgcagagatcagatgcaactcaaggatacgctctccagcagtttaatctgccagcaacagaagtgcattcgccctcttctgttcttatgtttaaccaaaccatggtaccacatgctgagctagatggtgcgaccaaccgtgaagaagtacatggcagcaggtacttgtcatccaatgcaatagggagagaagctgaaccatggccatccatggagcagcaaagagcgagtgtaaatggaagcgagcctctcgacacaactgaagcctcagctcctgcaaggaacgctgaatctggatcggtcggcaggggcgtggggcgaagcagctgtaagctttttggtttctccctgactgagaagatccttgcaacggatggtggtggtgtaaaagaaggaaactacgaagtggaccgtcaaactccccgggtgctagacttgtttgggcacggttctacgcctggtgctctgcatgctctctgtgctgctcccttgggaatatgatgctgttctgcctagttttacagcagttagatttatgtaatccttcagccattttcatcgcgttgtacttgaccaatatgtccagcgtatgatttccagttttaattgtatgctgatgctacatatcctctcttgagatccatgcatgagaattctggcagaatgaataaaggtaaattgatgtcc

SEQ ID NO: 136 - protein, 680 aa, Zea mays
  misc_feature: Ceres CLONE ID no.1598488
  misc_feature: Bit score of 1482.2 for hmm based on sequences of FIGURE 5.
  misc_feature (129)..(234): Pfam Name: B3 Pfam Description: B3 DNA binding domain
  misc_feature (256)..(337): Pfam Name: Auxin_resp Pfam Description: Auxin response factor
  misc_feature: Is Acted Upon By Ceres SEEDLINE ID no. ME00572 at SEQ ID NO. 111
MGIDLNAVGEDDPAGAVCAELWHACAGAGVALPRRGSAVVYLPQAHLAAGGCDGGGMSAPAPPRVPPHVVCRVVDVELRADAATDEVYARLALVAMDTMFGRNINDGETEEKNGEEEDGDGEKKHASHMFCKTLTASDTSTHGGFSVPRRAAEDCFPPLDYEQLRPSQELIAKDLHGMKWRFRHIYRGQPRRHLLTTGWSSFINKKKLVSGDAVLFLRGNDGELRLGVRRAVQLKNEALLEAVNCTDSKLLMLSAVANSLDNRSIFHICFNPRVGASEFIVPYCKFLKSLNYPFSVGTRFKVGCENEDANERSFGLIIGISEVDPIHWPGSKWKSLLIKWDGATKYSHQNRVSPWDIEGVGSSVSVTHRLSSSVSKRTKLCFPPSDLDTPILDGNGRPDSVETERFHRVLQGQELVHSSIHGAACSHSSDSPRCQGSYGRRFSADAWNCKMNDVMSGPRHLNATGFAYQPLGFSESVKFSEVLQGQEMSQAVPSFMRSAFNSGTQNGRVRPFDYVQRSDATQGYALQQFNLPATEVHSPSSVLMFNQTMVPHAELDGATNREEVHGSRYLSSNAIGREAEPWPSMEQQRASVNGSEPLDTTEASAPARNAESGSVGRGVGRSSCKLFGFSLTEKILATDGGGVKEGNYEVDRQTPRVLDLFGHGSTPGALHALCAAPLGI

SEQ ID NO: 137 - protein, 655 aa, Oryza sativa subsp. indica
  misc_feature: Public GI ID no.125527740
  misc_feature: Bit score of 1060.7 for hmm based on sequences of FIGURE 5.
  misc_feature (114)..(219): Pfam Name: B3 Pfam Description: B3 DNA binding domain
  misc_feature (241)..(322): Pfam Name: Auxin_resp Pfam Description: Auxin response factor
  misc_feature: Is Acted Upon By Ceres SEEDLINE ID no. ME00572 at SEQ ID NO. 111
MGIDLNYTASGGEEDAPAPAPVCRDLWHACAGPVVSLPRRGSAVVYLPQGHLSAAGAGGRIRGEVAVALPPHVACRVVDVELCVFERNLHGGGIEREDDMEDGDEERKSRMLHMFCKTLTASDTSTHGGFSVPRRAAEDCFPPLDHKQLRPSQELVAKDLHGAKWRFRHIYRGQPRRHLLTTGWSSFVNKKKLVSGDAVLFLRGDDGELRLGVRRATQLKNEAIFKAFSSESSKMRTLSAVADSLKHGSVFHICYNPRATASEYVVPYWKFVKSFNHPVCIGMRFKFHYESEDVNERRSGMIAGVSEVDPIRWPGSKWRSLLVRWEDATDCNSQNRVSPWEIEIVGGSISVAHSLSASSSKRTKLCPQGNLDVPALYGNGRPDSVETEKFPRVLQGQELMGSRTHRVTCSPQSIDITKSKSFDAWRFLTDTRSCMLGSSTSRLPVQYSGYTHQSVSFGESIGFPEVLQGQEISQTVPPIQGMLPDACSAKSRYELKNYVCTPATMNGLSSANEGYCLSLSTVPPSPPSSLMLYQTGVPQLELASKNNDKSGNDSQPALRQHKLLSETSWDQFKIGKASTPGNATKPGNGGREVDRTSCRLFGFSLTEKIIPTDKDGEKEVSYETDCQNPRMLDLFGYNCSTPGALHALCAAPLGI

SEQ ID NO: 138 - protein, 719 aa, Oryza sativa subsp. indica
  misc_feature: Public GI ID no.125553314
  misc_feature: Bit score of 1618.5 for hmm based on sequences of FIGURE 5.
  misc_feature (141)..(246): Pfam Name: B3 Pfam Description: B3 DNA binding domain
  misc_feature (268)..(349): Pfam Name: Auxin_resp Pfam Description: Auxin response factor
  misc_feature: Is Acted Upon By Ceres SEEDLINE ID no. ME00572 at SEQ ID NO. 111
MTGIDLNTVEEDEEEAAEEVAANGSSPAPARAGAVCLELWHACAGPVAPLPRKGGVVVYLPQGHLEHLGDAPAAAAAAAAVPPHVFCRVVDVTLLADAATDEVYAQLSLVPEKEEVARRADDGEGEDGDGMKQRFARMPHMFCKTLTASDTSTHGGFSVPRRAAEDCFPPLDYSQQRPSQELVAKDLHGTEWRFRHIYRGQPRRHLLTTGWSAFVNKKKLVSGDAVLFLRGDDGELRLGVRRAAQLKNGSAFPALYNQCSNLGTLANVAHAVATESVFNIYYNPRLSQSEFIVPYWKFMKSLSQPFSVGLRFKMRYESEDASERRYTGIITGSGDTDPMWHGSKWKCLLVRWDDDAEFRRPNRVSPWEIELTSSVSGSHLSTPHSKRLKPCLPHVNPEYMVPRGGGCPDFAESAQFHKVLQGQELLGFKSHGGTAAATSQPCEARHLQYIDERSCSSDASNSILGVPRLGDRAPLGNPGFSYHCSGFGESQRLQKVLQGQELFRPYRGTLVDASMGSNGFHQQDSPRAPGVVNKWQAQLHGRAAFHGPPALALPSQSSSPPSVLMFQQANSKMPRLEFGHGQLDKHENDRRVRFGPSEGIERREQRIPLQPYPTSGEVIDGQVTVEKSHSPGRHGKDGPDNKAVGTNSCKIFGISLTEKVPAREELDDGDANYSLQSLKQVPKSLGNSCATMVAEYQGDGGTDDSDIFILDVGVGALIM

SEQ ID NO: 139 - protein, 788 aa, Arabidopsis thaliana
  misc_feature: Ceres LOCUS ID no. At5g60450
  misc_feature: Bit score of 808.3 for hmm based on sequences of FIGURE 5.
  misc_feature (176)..(281): Pfam Name: B3 Pfam Description: B3 DNA binding domain
  misc_feature (302)..(384): Pfam Name: Auxin_resp Pfam Description: Auxin response factor
  misc_feature: Is Acted Upon By Ceres SEEDLINE ID no. ME00572 at SEQ ID NO. 111
MEFDLNTEIAEVEEEENDDVGVGVGGGTRIDKGRLGISPSSSSSCSSGSSSSSSSTGSASSIYSELWHACAGPLTCLPKKGNVVVYFPQGHLEQDAMVSYSSPLEIPKFDLNPQIVCRVVNVQLLANKDTDEVYTQVTLLPLQEFSMLNGEGKEVKELGGEEERNGSSSVKRTPHMFCKTLTASDTSTHGGFSVPRRAAEDCFAPLDYKQQRPSQELIAKDLHGVEWKFRHIYRGQPRRHLLTTGWSIFVSQKNLVSGDAVLFLRDEGGELRLGIRRAARPRNGLPDSIIEKNSCSNILSLVANAVSTKSMFHVFYSPRATHAEFVIPYEKYITSIRSPVCIGTRFRMRFEMDDSPERRCAGVVTGVCDLDPYRWPNSKWRCLLVRWDESFVSDHQERVSPWEIDPSVSLPHLSIQSSPRPKRPWAGLLDTTPPGNPITKRGGFLDFEESVRPSKVLQGQENIGSASPSQGFDVMNRRILDFAMQSHANPVLVSSRVKDRFGEFVDATGVNPACSGVMDLDRFPRVLQGQEICSLKSFPQFAGFSPAAAPNPFAYQANKSSYYPLALHGIRSTHVPYQNPYNAGNQSSGPPSRAINFGEETRKFDAQNEGGLPNNVTADLPFKIDMMGKQKGSELNMNASSGCKLFGFSLPVETPASKPQSSSKRICTKVHKQGSQVGRAIDLSRLNGYDDLLMELERLFNMEGLLRDPEKGWRILYTDSENDMMVVGDDPWHDFCNVVWKIHLYTKEEVENANDDNKSCLEQAALMMEASKSSSVSQPDSSPTITRV

SEQ ID NO: 140 - DNA, 2064 bp, Populus balsamifera subsp. trichocarpa
  misc_feature: Ceres ANNOT ID no.1515383
  misc_feature: Encodes the peptide sequence at SEQ ID NO. 141
atggaaattgatctgaatcatccagtgactgaggtggagaagaattcattttgtaccaatggggactcttcatgttcttctaattcatcttcatctccagtttcctcttcaatttacttggagctttggcatgcttgtgctggtcctctcacttctctccctaagaaagggaatgtggttgtctacttccctcaaggccacttggagcagcttgcctcttcctctcctttctctcatagggacatgcccaattttgatctccacccacaaatattttgcaaagttgtaaatgtgcagctacttgccaatagggaaaatgatgaggtctacactcggcttactttgcttcctcaaccagaggtggtaggacaggatttagaaggcaaagagcttcaagagttaggcgtggatggagagggtgacgacgcatcaccaacaaaatcaaccccacacatgttttgcaaaacactcacagcttctgatactagcacccatggagggttttccgttcctcgaagagctgccgaagactgtttcccttcactggattataaacagcagagaccctctcaagagcttttggccaaagacttgcatggagttgaatggagatttcgtcatatttacagaggtcaaccaagaaggcatcttctaactacgggatggagtatttttgtgagtcaaaagaatcttgtttcaggggatgcagtgctatttctgaggggcgaaggtggagagttgagactggggatcagacgagctgctcgacctagaaatggtcttcctgattctgttactggcaagcagaattcacttcccagtgctctctccttggtgtctaatgcaatatccaccaagagcgtgttcactgtttcatatagtccaagggccactcatgcagtgtttgttgtaccctaccaaaagtatataaaaagcatcaccaatgcagtttgcatcgggacaagattcaaaatgagatttgaaatggatgattctcctgaaagaaggtgtagcggtgtagtaactggaacagctgacttggatccctataagtggcccaactcaaaatggaggtgcttaatggttagatgggatgaagatgtcatcagtgatcatcaagaacgagtttccccatgggaaattgacgcttctgtttcactcccacccttgattattcaatcttcaccaaggttgaagaaactgcggactgggctgcaagcagccccacctgataagcccatagctggagggggtgggtttttggatttcaaggagtctgtaagatcctccaaggtcttgcaaggtcaagaaatatgctcgttgagttctgttggtgctttgggaaagcccaatactggacgcagttctttccagatgtatccaggaccaagacccgctttctatcctgtagcagcagaaagccttagaagtatgtactttccctatggagatgtatacaaaaatggtcaagatcccagaacacaatcttatgctatcttctctagagaaaatgcccatttcaatacatcttctattcagacttgtgtggttagggaagaagttagaaagcctaatcaatcaagcgagtataagacacaagaaagtatttctgctgcaccggctttatgtgcaaatctaagaaaccaaaaggatgacttttttaatgggaatgctactggctgcaaactttttgggttctccttgaatgcagaaacatctccaaattcgcagaacactagtaagaggagttgcacaaaggttcacaagcaaggtagcttggtcggaagagctattgatctttcaaggctgaatggctatagtgatctcttgaatgaactagagcgactatttagcatggagggtcttttacgaaatcctgaggaaggatggcgaatcttgtatactgacagtgagaatgatgttatggttgtcggagatgacccatggcttgagttctgtaatgtggcaaccaagatccatatatatacccaagaagaagtggagaagatgaccgttggaattactggggacgatactcaaagttgtttggatcaagccctgtga

SEQ ID NO: 141 - protein, 687 aa, Populus balsamifera subsp. trichocarpa
  misc_feature: Ceres ANNOT ID no.1515383
  misc_feature: Bit score of 794.3 for hmm based on sequences of FIGURE 5.
  misc_feature (152)..(257): Pfam Name: B3 Pfam Description: B3 DNA binding domain
  misc_feature (279)..(361): Pfam Name: Auxin_resp Pfam Description: Auxin response factor
  misc_feature: Is Acted Upon By Ceres SEEDLINE ID no. ME00572 at SEQ ID NO. 111
MEIDLNHPVTEVEKNSFCTNGDSSCSSNSSSSPVSSSIYLELWHACAGPLTSLPKKGNVVVYFPQGHLEQLASSSPFSHRDMPNFDLHPQIFCKVVNVQLLANRENDEVYTRLTLLPQPEVVGQDLEGKELQELGVDGEGDDASPTKSTPHMFCKTLTASDTSTHGGFSVPRRAAEDCFPSLDYKQQRPSQELLAKDLHGVEWRFRHIYRGQPRRHLLTTGWSIFVSQKNLVSGDAVLFLRGEGGELRLGIRRAARPRNGLPDSVTGKQNSLPSALSLVSNAISTKSVFTVSYSPRATHAVFVVPYQKYIKSITNAVCIGTRFKMRFEMDDSPERRCSGVVTGTADLDPYKWPNSKWRCLMVRWDEDVISDHQERVSPWEIDASVSLPPLIIQSSPRLKKLRTGLQAAPPDKPIAGGGGFLDFKESVRSSKVLQGQEICSLSSVGALGKPNTGRSSFQMYPGPRPAFYPVAAESLRSMYFPYGDVYKNGQDPRTQSYAIFSRENAHFNTSSIQTCVVREEVRKPNQSSEYKTQESISAAPALCANLRNQKDDFFNGNATGCKLFGFSLNAETSPNSQNTSKRSCTKVHKQGSLVGRAIDLSRLNGYSDLLNELERLFSMEGLLRNPEEGWRILYTDSENDVMVVGDDPWLEFCNVATKIHIYTQEEVEKMTVGITGDDTQSCLDQAL

SEQ ID NO: 142 - DNA, 2722 bp, Zea mays
  misc_feature: Ceres CLONE ID no.462443
  misc_feature: Encodes the peptide sequence at SEQ ID NO. 143
agacaaccaaacgaaccctcccggagcagcaaagcataggcgctcgagcgctccctcccgagctcctccgcctcacggtcacgcctcgtgtccccccaccccctcctcctcctcctcggccggccgcctcacgccgtcacctccgctcggcgagtctcggctccgaccgctgccgccacgtgcgacctcccctactcctgagagatctgcggggctcggcatggggtgaccagatcgggccgctgctcggtgctttccagctgaattttgcccgcagctcgtgtcggaggcagcgaagatggcggaggccggcgtggcacgcggctcagggagcgctggcgatgctttgttcagggaactctggcatgcttgtgctgggccgttggtcacagtgcctcgccaaggcgagctggtttattacttcccccagggtcatatggaacagcttgaagcgtctacagatcaacaacttgatcagcacttgcctttgtttaatctaccgcacaagatcctctgcaaggtggtcaatgtagaacttagagctgaaactgattctgatgaagtttatgctcaaattatgctgcaaccacaaacagagcaaagtgagcccaccagcccagatcctgaaccacctgagcctgaaagatgcaacattcattccttctgcaagaccttgactgcttcagatacaagtacccatggtctctctgtcctcaggaggcatgctgaagaatgtttgccccaactggacatgactcagaatccaccgtggcaagaactagtggctaaagatctccatggaaatgaatggcatttccgtcacatctttcgagggcaaccaaggaggcatctacttacgacaggctggagtgtttttgttagctcaaaaagattggttgcgggtgacgcgtttatcttcttgagaggtgagaacggagagctgcgagtcggggtaaggaggctcatgagacaactaaataacatgccgtcttcggttatctcaagccacagcatgcatcttggagtcctagcaactgcatctcatgccatctccactggaactctattttctgttttctacaaacccagaacaagtagatctgaatttgtcgttagtgtaaacaagtacctcgaagctaagaatcacaagatgtctgttggtatgaggtttaaaatgagatttgagggtgatgaatcccctgaaagaagattcagtgggataattattggtatgggatgcatgccagctaactcaacatctccatgggctaactctgaatggagatcattgaaggtccaatgggacgagccttctgctattctgcgtccagatagagtttcaccatgggaagtagaaccccttaatcgaacaaatccacagccacctcaacctcctttacggaataagcgagcacggcctcctgcttcaccttcgattgctccagaacttgctccagtttttggtttttggaagtccccagctgagcctgcccaagctttctcattctcaggactgcagcgaactcaggagctataccattcaagccccagttcaatgttctcatcgtcgttgaatgtgggattcaatccaaagtacgagggtcccactccaaacaccaaccatttgtactggacaatgagagagacaagaactgaatcctactccgctagcatcaacaaagctccaactgaaaagaagcaagaatccactacttctggctgcagattgttcggtatcgagataggttcttctgcagtgtcacccgtggttactgttgctagcgtcgggcatgatcctccgccacctgctctctcagtagacgctgaatctgaccagctgtcacagccgtcccatgccaacaaagcaacggatgccccagcggcaagcagcgatcgctctcctaacgagacagagagccggcaagccaggagctgcaccaaggtaatcatgcaaggggtggcggttggcagggcggtggacttgacgaggctagatgggtacgatgacctccgccgcaagttggaggagatgttcgatatcccgggagagctttccgccagcctcaataaatggaaggtgatctacacagatgacgaggacgatatgatgctggtcggggacgatccatggagtgaattttgcaggatggtaaaaaggatatacatttattcctacgaggaggccaagtctttgactcccaaggcgaagctgccggccatcggtggtgacaccggcgtcaagccggacccaagtaaactgtcagcagaatctgacgtgccacagagcgactccgacaacagtgctcccgtttctgctgataaggactgatggacgctagctcggccgtaccttctctttatgttggccatgggaggccagtgcagtgcccatgctccttgagactgctaagaattgatcatctgttccatctgcctcggcttggaccagcgaggatggccgggagggagtgcatgccgctccgtgcgtgtttcgtttgccgtgtttggtaggagccatggcttgttgccggctacttgggttctgtagactgttacactgactgctgccgtctcacctggccgtcggcgcgggccgccccctctcacctctctagtaatatactagggcttatgtacacacagctgttttggtagtggcatatgtatatcgtcggtcatgttgcttgcgacatttagcatcctccgtagctgctatttcctc

SEQ ID NO: 143 - protein, 676 aa, Zea mays
  misc_feature: Ceres CLONE ID no.462443
  misc_feature: Bit score of 1504.3 for hmm based on sequences of FIGURE 5.
  misc_feature (121)..(225): Pfam Name: B3 Pfam Description: B3 DNA binding domain
  misc_feature (247)..(332): Pfam Name: Auxin_resp Pfam Description: Auxin response factor
  misc_feature: Is Acted Upon By Ceres SEEDLINE ID no. ME00572 at SEQ ID NO. 111
MAEAGVARGSGSAGDALFRELWHACAGPLVTVPRQGELVYYFPQGHMEQLEASTDQQLDQHLPLFNLPHKILCKVVNVELRAETDSDEVYAQIMLQPQTEQSEPTSPDPEPPEPERCNIHSFCKTLTASDTSTHGLSVLRRHAEECLPQLDMTQNPPWQELVAKDLHGNEWHFRHIFRGQPRRHLLTTGWSVFVSSKRLVAGDAFIFLRGENGELRVGVRRLMRQLNNMPSSVISSHSMHLGVLATASHAISTGTLFSVFYKPRTSRSEFVVSVNKYLEAKNHKMSVGMRFKMRFEGDESPERRFSGIIIGMGCMPANSTSPWANSEWRSLKVQWDEPSAILRPDRVSPWEVEPLNRTNPQPPQPPLRNKRARPPASPSIAPELAPVFGFWKSPAEPAQAFSFSGLQRTQELYHSSPSSMFSSSLNVGFNPKYEGPTPNTNHLYWTMRETRTESYSASINKAPTEKKQESTTSGCRLFGIEIGSSAVSPVVTVASVGHDPPPPALSVDAESDQLSQPSHANKATDAPAASSDRSPNETESRQARSCTKVIMQGVAVGRAVDLTRLDGYDDLRRKLEEMFDIPGELSASLNKWKVIYTDDEDDMMLVGDDPWSEFCRMVKRIYIYSYEEAKSLTPKAKLPAIGGDTGVKPDPSKLSAESDVPQSDSDNSAPVSADKD

SEQ ID NO: 144 - DNA, 329 bp, Arabidopsis thaliana
  misc_feature: Public GI No. 21403834
  misc_feature: Homolog Of Ceres SEEDLINE ID no. ME00572 at SEQ ID NO. 111
  misc_feature: FRAGMENT
tatctgagcttttagtcggattttttcttttcaattattgtgttttatctagatgatgcatttcattattctctttttcttgaccttgtaaggccttttcttgaccttgtaagaccccatctctttctaaacgttttattattttctcgttttacagattctattctatctcttctcaatatagaatagatatctatctctacctctaattcgttcgagtcattttctcctaccttgtctatccctcctgagctaatctccacatatatcttttgtttgttattgatgtatggttgacataaattcaataaagaagttgacgtttttcc

SEQ ID NO: 145 - DNA, 350 bp, Solanum lycopersicum
  misc_feature: Public GI No. 158087544
  misc_feature: Homolog Of Ceres SEEDLINE ID no. ME00572 at SEQ ID NO. 111
  misc_feature: FRAGMENT
cctaacgatgagtgtcgcatcctcatcttaatctcggtgctatcctacctgagctttttctcaccgcttttttttttctgttgtgtattctcttttttgacttgttgcctttcgttcctctacctaccccattcttcttgaccttgtaagaccttttcttgaccttgtaagaccccgtgttatctcttacgtctttatgttttgtttttttgcaaatcttacgtcatgacttcttcatgtaagctttgtttggtctccttcttctttcctactcaactctcgttctccttccttgtctatccctcctgagctgttgattttattccatgtacaattgaacacaacaaaaa

SEQ ID NO: 146 - DNA, 197 bp, Brassica rapa
  misc_feature: Public GI No. 110797273
  misc_feature: Homolog Of Ceres SEEDLINE ID no. ME00572 at SEQ ID NO. 111
  misc_feature: FRAGMENT
aaaaaatttctttctcccactgaatgattttttattttcttgaccttgtaaggccttttcttgaccttgtaagaccccatccctttctaagtgtttccttcttctatcatcttacagattttcttttatctctttttggtgtaagatatgtatgtatatctacccctagtttgtctgagtcatcttctcctaccttg

SEQ ID NO: 147 - DNA, 207 bp, Medicago truncatula
  misc_feature: Public GI No. 118566241
  misc_feature: FRAGMENT
  misc_feature: Homolog Of Ceres SEEDLINE ID no. ME00572 at SEQ ID NO. 111
gagcttttttttcacctttctcttttcttaactttttttttactctacttgtgtcttcttgaccttgtaagaccttttcttgaccttgtaagacctcactctgtgtcggttttctttgtttttgcttttgtggaagacgctatatcgaaatttgttgatatagagtttcgtctccgtttttcccttttaccacccaactcattctct

SEQ ID NO: 148 - DNA, 188 bp, Vitis vinifera
  misc_feature: Public GI No. 147857869
  misc_feature: FRAGMENT
  misc_feature: Homolog Of Ceres SEEDLINE ID no. ME00572 at SEQ ID NO. 111
cccggttgtgtttccttttgttcgggtcattacttcttcttgaccttgtaagaccttttcttgaccttgtaagaccccgggcaaaatccgctatccttattatatcagtcgagaaggacttcctattagacactactgataaagagttcaataatcaatacttgatgtccccaacctactcgtcatct

SEQ ID NO: 149 - DNA, 182 bp, Oryza sativa
  misc_feature: Public GI No. 58530789
  misc_feature: FRAGMENT
  misc_feature: Homolog Of Ceres SEEDLINE ID no. ME00572 at SEQ ID NO. 111
aaaacctcaacatcactttgtgtgggaattaaaaggaattggtcttcttgaccttgcaagaccttttcttgaccttgtaagacccaacatcgttgtgttgtttttcttgtttcttatttttcaatttcatccacctcttctttctacctcccatctttctcctagttcttgccttctctctc

SEQ ID NO: 150 - DNA, 232 bp, Zea mays
  misc_feature: Public GI No. 21212701
  misc_feature: FRAGMENT
  misc_feature: Homolog Of Ceres SEEDLINE ID no. ME00572 at SEQ ID NO. 111
ccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcaggatacctggatcccaaactagctggccaacatggcgaacgatgaccctgtggacgacg

SEQ ID NO: 151 - DNA, 549 bp, Manhiot esculenta
  misc_feature: Public GI No. 119010892
  misc_feature: Homolog Of Ceres SEEDLINE ID no. ME00572 at SEQ ID NO. 111
ttttttttttctcttcttctccttctccttctccttctcatctctctctctctctctctctctctcagcatgaaagagagaggaaagcattcagaggtgaaactcaggcataagtttcttcaaggcattcatgaagttaaaatcatgaacaacgccaccatctgcaacgcttccagtggtgggtttttggctggcttctcgtttggggctaaaagtccctttggaatggtggttggttcatgttgatggggtgctatcctacctgagctttttctattattttcctttttattttttttcttacttttgtttttaatcttcttgaccttgtaagaccttttcttgaccttgtaagacccctttttatgtttatttatcttaatttttgtattgtcataaattctatatcaaaattttttgatatagaatttcatgtttatttttttctgtttttgcccaactcatattctccttccttgtctatccctcctgagctatttgaataaaattattatgctaattattcagaaaaaaaaaaaaaaaaaatcg

SEQ ID NO: 152 - DNA, 168 bp, Populus balsamifera subsp. Trichocarpa
  misc_feature: 000POPULUS
  misc_feature: Homolog Of Ceres SEEDLINE ID no. ME00572 at SEQ ID NO. 111
gtttttttttttgtttttttttcttgaccttgtaagaccttttcttgaccttgtaagaccccattttttgttctttgtttctatagcatccctcttgccacccaactcatcatctccttctctgtctatccctcctgagctatttcgatcacaccgcaagatcacatt

SEQ ID NO: 153 - DNA, 167 bp, Theobroma cacao
  misc_feature: 000THEOBROMA
  misc_feature: Homolog Of Ceres SEEDLINE ID no. ME00572 at SEQ ID NO. 111
  misc_feature (69)..(69): n is a, c, t, g, unknown, or other
  misc_feature (71)..(71): n is a, c, t, g, unknown, or other
tttcttcttcttttcttatcttcttgaccttgtaagaccttttcttgaccttgtaagaccccgttcggngntccttggttttgcttctaccccattcccgccaacttttcttctcccttccttgctatccctcctgagctggttgaattagcctagcctagctatag

SEQ ID NO: 154 - DNA, 168 bp, Malus x domestica
  misc_feature: 000MALUS
  misc_feature: Homolog Of Ceres SEEDLINE ID no. ME00572 at SEQ ID NO. 111
cgcatcgatcccttccctttttcttgaccttgtaagaccttttcttgaccttgtaagatgtcatgccaggtctgttgtctttggttcctcatcgttavvgvvvaattcatcttctccttccttgtctatccctcctgagctgttccacaattacctcaaactacaagc

SEQ ID NO: 155 - DNA, 168 bp, Glycine max
  misc_feature: 000GLYCINE
  misc_feature: Homolog Of Ceres SEEDLINE ID no. ME00572 at SEQ ID NO. 111
gtttttcccttggagtcttcttcttgaccttgtaagaccttttcttgaccttgtaagacctcacaccctatctcttctctttgttctttccccgttaccacccaactcatactttccttccttgtctatccctcctgagctgttccaatttaattaatttggcctacc

SEQ ID NO: 156 - DNA, 168 bp, Lotus japonicus
  misc_feature: 000LOTUS
  misc_feature: Homolog Of Ceres SEEDLINE ID no. ME00572 at SEQ ID NO. 111
ccttgtttccccctccggtcttcttgaccttgtaagaccttttcttgaccttgtaagacctcacgccgtgtctgttttcttcagtctttccccgttaccgtccaactcatcctctccttccttgtctatccctcctgagctatttcaattttggccaagcatgccaca

SEQ ID NO: 157 - protein, 165 aa, Sorghum bicolor
  misc_feature: Ceres Annot ID no. 8670388
  misc_feature: Truncated
  misc_feature (1)..(165): Bit score of 420.2 for hmm based on sequences of FIGURE 4.
  misc_feature: Functional Homolog Of SEQ ID NO. 93
MIDTMIPLMKHSPYGARIVNVSSRLGRANGRRNRIGDASLRDRLLKDDCLSEQLVDEMITKFLEQVKQGTWSSNEWPQMYTDYSISKLAVNVYTRLMARRLSDRPEGQKIYINCFCPGWVNTAMTGWEGNISAEEGADTGVWLALLPQEPPTNGKFFAERCEISF

SEQ ID NO: 158 - protein, 165 aa, Zea mays
  misc_feature: Public GI ID no. 194696386
  misc_feature: Truncated
  misc_feature (1)..(165): Bit score of 411.4 for hmm based on sequences of FIGURE 4.
  misc_feature: Functional Homolog Of SEQ ID NO. 93
MIDAMIPLMKRSAYGARIVNVSSRLGRANGRRNRIGDVSLRDRLLKDDCLSEQLIDEMITKFLEQAKQGTWSLNEWPQMYTDYSISKLAVNAYTRLMARRLSDRPEGQKIYINCFCPGWVKTAMTGWEGNVSAEEGADTGIWLALLPQETDTNGKFFAERCEISF

SEQ ID NO: 159 - protein, 163 aa, Panicum virgatum
  misc_feature: Ceres Clone ID no. 1906273
  misc_feature: Truncated
  misc_feature (1)..(163): Bit score of 400.6 for hmm based on sequences of FIGURE 4.
  misc_feature: Functional Homolog Of SEQ ID NO. 93
MLTEALLPLFRQSPATSRILNISSQLGLLNKVSDSSLKALLLDEETLTEAAIDAMVSRFLAQVKDGTWGAQGWPKVWTDYSVSKLALNAYSRLLARRLQARGARVSVNCFCPGFTRTDMTRGWGKRTAEEVADVGARLALLPPGELPTGAFFKWCTPQLYSKL

SEQ ID NO: 160 - protein, 161 aa, Zea mays
  misc_feature: Ceres Clone ID no. 100894176
  misc_feature: Truncated
  misc_feature (1)..(161): Bit score of 364.2 for hmm based on sequences of FIGURE 4.
  misc_feature: Functional Homolog Of SEQ ID NO. 93
MLTEALLPLFRQSSATSRILNISSQLGLLNKVGDPSLKALLLDEERLTEAGIEAMVSRFLAQVKDGTWGEQGWPKVWTDYSVSKLALNAYSRLLARRLEARGVSVNCFCPGFTRTDMTRGWGKRTAGEAADVGARLALLPPTELPTGTFFKWRTPQLYSKL

SEQ ID NO: 161 - protein, 164 aa, Solanum lycopersicum
  misc_feature: Ceres Annot ID no. 8459736
  misc_feature: Truncated
  misc_feature (1)..(164): Bit score of 361.8 for hmm based on sequences of FIGURE 4.
  misc_feature: Functional Homolog Of SEQ ID NO. 93
MIKALTPLMRPSPAGSRIVSVTSRLGRLNSKRNGISNVAVREQLENVDTLSEEVIDKTMHTFLEQVKDGTWESAGWPHVFTDYSLSKLAVNAYTRLMARIFEERPEGEKIYINCYCPGWVKTAMTGWAGHVTIEEAADTAVWLALLPDQFVSGKFFAERREINF

SEQ ID NO: 162 - DNA, 975 bp, Sorghum bicolor
  misc_feature: Ceres Annot ID no. 8670388
  misc_feature: Encodes the peptide sequence at SEQ ID NO. 163
atggggaagaaagggaaggaggcggcgcgggagcggcgcgagcagcgccgccgcgaggtcaccctcctccgggctctcccctacgagccccaccagcgatggtgggaccgcctggcgccgcgggccgtggcggtggtcacgggcgccaaccgcgggataggcttcgaggccgcccgccagctcgcgctccacggcctgcacgtcgtgctcgcctcccgcgacgccgccaagggccaggacgccgcggggaggatcctggcggaggctcccgatggcgcggtcgtcagcgtggagtcccggcagcttgacgtggcggacgccgcgtccgtggaggccttcgcggcctgggcggtggaaacccacggcggcatccatgtccttgttaacaatgcaggtgtaaacttcaacaaaggagcagataattctgttgagtttgctgagcaagttatcaagacaaattactatggcacaaagcggatgattgatactatgataccactaatgaaacactccccgtatggtgctcggatagtgaatgtcagctcaaggcttggtagagccaatggcagacggaatagaattggtgatgcgagtctaagagatcgtctgttgaaagatgattgtttatcagagcagctagttgatgagatgatcacgaaatttctcgaacaagtcaagcaaggtacttggtcctccaatgagtggccacagatgtacacggactattcgatctcaaagcttgctgttaatgtttatacacgactgatggcaaggaggctctcggatcgacctgaaggccaaaagatatacattaactgtttctgccctggctgggtaaatactgccatgactggttgggaagggaatatttctgccgaagaaggtgctgacacaggtgtatggctcgccttattacctcaggaaccacccacaaatgggaagttcttcgctgagagatgtgagataagcttctaa

SEQ ID NO: 163 - protein, 324 aa, Sorghum bicolor
  misc_feature: Ceres Annot ID no. 8670388
  misc_feature (1)..(324): Bit score of 760.0 for hmm based on sequences of FIGURE 3.
  misc_feature (42)..(195): Pfam Name: adh_short Pfam Desc: short chain dehydrogenase
  misc_feature: Functional Homolog Of SEQ ID NO. 74
MGKKGKEAARERREQRRREVTLLRALPYEPHQRWWDRLAPRAVAVVTGANRGIGFEAARQLALHGLHVVLASRDAAKGQDAAGRILAEAPDGAVVSVESRQLDVADAASVEAFAAWAVETHGGIHVLVNNAGVNFNKGADNSVEFAEQVIKTNYYGTKRMIDTMIPLMKHSPYGARIVNVSSRLGRANGRRNRIGDASLRDRLLKDDCLSEQLVDEMITKFLEQVKQGTWSSNEWPQMYTDYSISKLAVNVYTRLMARRLSDRPEGQKIYINCFCPGWVNTAMTGWEGNISAEEGADTGVWLALLPQEPPTNGKFFAERCEISF

SEQ ID NO: 164 - protein, 313 aa, Vitis vinifera
  misc_feature: Public GI ID no. 147853829
  misc_feature (1)..(313): Bit score of 757.9 for hmm based on sequences of FIGURE 3.
  misc_feature (37)..(185): Pfam Name: adh_short Pfam Desc: short chain dehydrogenase
  misc_feature: Functional Homolog Of SEQ ID NO. 74
MGRKERAEERRKQRQQEISLFRTIPYSDHQRWWNSETIAVVTGANRGIGFEIARQLCGHGLTVILTSRDSAIGREAASVLQEGGFNAVSHQLDVLDPSSIEQFAEWVQQNYGFVDILINNAGVNYNMGSENSVENAENVIATNYFGTKNVIKAMVPLMKPSASGARIVNVSSRLGRINGRRNKIEDSALRGQLEDVDSLSEEVIDQMVHTFVEQVKDGTWTSAGWPQTFTDYSVSKLAVNCYTRIMAKVLSDRPEGEKIFINCYCPGWVKTAMTGWAGNVSVEEGADTGVWLALLPDQSVTGKIFAERREVHF

SEQ ID NO: 165 - protein, 324 aa, Zea mays
  misc_feature: Public GI ID no. 194696386
  misc_feature (1)..(324): Bit score of 755.3 for hmm based on sequences of FIGURE 3.
  misc_feature (42)..(195): Pfam Name: adh_short Pfam Desc: short chain dehydrogenase
  misc_feature: Functional Homolog Of SEQ ID NO. 74
MGKKGKEAARERREQRRREVALLRSLPYEPHQRWWDRLAPRAVAVVTGANRGIGFEAARQLALHGLHVVLACRDAAKGQDAAERILAEAPDDTVVSVESRKLDVADAASVEAFAAWAVETYGGIHVLVNNAGVNFNKGADNSVEFAEQVIETNYYGTKRMIDAMIPLMKRSAYGARIVNVSSRLGRANGRRNRIGDVSLRDRLLKDDCLSEQLIDEMITKFLEQAKQGTWSLNEWPQMYTDYSISKLAVNAYTRLMARRLSDRPEGQKIYINCFCPGWVKTAMTGWEGNVSAEEGADTGIWLALLPQETDTNGKFFAERCEISF

SEQ ID NO: 166 - DNA, 942 bp, Solanum lycopersicum
  misc_feature: Ceres Annot ID no. 8459736
  misc_feature: Encodes the peptide sequence at SEQ ID NO. 167
atggataaaaaggaaagggcaaaggaaaaaaaggagaaaagacgccaggagatctcccttctacgtactattccctattctgatcaccaaagatggtggtcatctgaaacaattgcggttgttacgggcgcaaatagaggcattggatttgaaattgctcatcagcttgcatcacatggcgttactgttgttctcacgtcgcgagagacagctgttggagaagaagcagtgaaagtctttcaggaaggaggtctaaatgtggcatttcatcaattggatattgtggatcctgtatcaattcaaacattttgtgattggattaaagaaacatatggtggcctagatatactgatcaacaatgcaggagtcaatttcaattgcggaaaagataattctgttgaattttctgaaatggtaatccaagttaactattttggcaccaaaaacatgatcaaagcacttactccgttgatgaggccttcccctgctggctctcgtattgttagtgtcacctcgcgattgggtagacttaatagcaaacgaaatggaatttcaaatgtagcagtgagagaacaattagaaaacgtggatacgctatctgaggaagttatcgataaaactatgcacacatttttggagcaagtaaaagatggaacttgggaatcagcaggatggcctcatgtgttcacagactactcattgtcaaagctagcagttaatgcctacacaaggttaatggcaaggatattcgaggaacgaccagaaggtgaaaaaatatacataaattgttattgtccgggatgggtgaaaactgctatgactggctgggcagggcatgttactattgaagaagctgctgatactgctgtatggcttgctttgctccctgatcaatttgtgagtggtaagttcttcgctgagaggcgcgaaattaacttttaa

SEQ ID NO: 167 - protein, 313 aa, Solanum lycopersicum
  misc_feature: Ceres Annot ID no. 8459736
  misc_feature (1)..(313): Bit score of 744.3 for hmm based on sequences of FIGURE 3.
  misc_feature (37)..(193): Pfam Name: adh_short Pfam Desc: short chain dehydrogenase
  misc_feature: Functional Homolog Of SEQ ID NO. 74
MDKKERAKEKKEKRRQEISLLRTIPYSDHQRWWSSETIAVVTGANRGIGFEIAHQLASHGVTVVLTSRETAVGEEAVKVFQEGGLNVAFHQLDIVDPVSIQTFCDWIKETYGGLDILINNAGVNFNCGKDNSVEFSEMVIQVNYFGTKNMIKALTPLMRPSPAGSRIVSVTSRLGRLNSKRNGISNVAVREQLENVDTLSEEVIDKTMHTFLEQVKDGTWESAGWPHVFTDYSLSKLAVNAYTRLMARIFEERPEGEKIYINCYCPGWVKTAMTGWAGHVTIEEAADTAVWLALLPDQFVSGKFFAERREINF

SEQ ID NO: 168 - DNA, 1198 bp, Panicum virgatum
  misc_feature: Ceres Clone ID no. 1906273
  misc_feature: Encodes the peptide sequence at SEQ ID NO. 169
agtcagccaccccccgcgctccccgctcgtctccagctcgatggactattcgagcaccaaggagttgcctccggccggggcctggtggtcgagggagacggtggccgtggtgacgggcgcgaaccggggcatcgggcacgccctcgccgcgcgcctggccgagcacgggctcaccgtggtgctcaccgcacgggacggcgcgcgcggggaggccgccgcggccccgctccgcgcgcgcgggctcgccgtcgccttccgcaggctcgacgtctccgacgccgcctccgtcgccgagttcgccgcctggctccgcgacgccgtcggcggcctcgacatcctggtgaacaacgcggccgtgtccttcaacgagatcgacaccaactcggtggagcacgccgagacagtcctcaggaccaacttccacggcgccaagatgctcacggaagcgctgctgccgctgttccggcagtccccggccaccagcaggatcctcaacatcagctcgcagcttggccttctcaacaaggtgagcgactcgtccctgaaggcgctgctcctggacgaggagaccctgacggaggcggcgatcgacgccatggtgtcgcggttcctggcgcaggtgaaggacgggacgtggggcgctcagggctggcccaaggtgtggacggactactcggtctccaagctggccctgaacgcctactcccggctgctggcgcggcggctgcaggcgcgcggcgcccgcgtgagcgtcaactgcttctgccccgggttcacgcgcaccgacatgaccaggggctgggggaagcgcaccgccgaggaggtggccgacgtcggcgcgcggctcgcgctgctgccgcccggcgagctccccacgggggccttcttcaagtggtgcacgccgcagctctactccaagctgtgacctgccgggagctagccacgccgccggccggcgcgccccggccatggcggcagtgggagtatatgtatgtagcgttggtttagctgctcctagtgacttgactccccatgcaaacaagaagtcgatcgagtagttagtgcctctggcagtctggctttctgccaaggtgctatggttgaagcaatgcaacctaaccatgtcagcaatcaatgtactatgcctagttagccgtgtaagatttaaagttaacttctgaacatgggaagaatcatg

SEQ ID NO: 169 - protein, 294 aa, Panicum virgatum
  misc_feature: Ceres Clone ID no. 1906273
  misc_feature (1)..(294): Bit score of 656.4 for hmm based on sequences of FIGURE 3.
  misc_feature (20)..(173): Pfam Name: adh_short Pfam Desc: short chain dehydrogenase
  misc_feature: Functional Homolog Of SEQ ID NO. 74
MDYSSTKELPPAGAWWSRETVAVVTGANRGIGHALAARLAEHGLTVVLTARDGARGEAAAAPLRARGLAVAFRRLDVSDAASVAEFAAWLRDAVGGLDILVNNAAVSFNEIDTNSVEHAETVLRTNFHGAKMLTEALLPLFRQSPATSRILNISSQLGLLNKVSDSSLKALLLDEETLTEAAIDAMVSRFLAQVKDGTWGAQGWPKVWTDYSVSKLALNAYSRLLARRLQARGARVSVNCFCPGFTRTDMTRGWGKRTAEEVADVGARLALLPPGELPTGAFFKWCTPQLYSKL

SEQ ID NO: 170 - protein, 319 aa, Olea europaea
  misc_feature: Public GI ID no. 198285679
  misc_feature (1)..(319): Bit score of 219.9 for hmm based on sequences of FIGURE 2.
  misc_feature (252)..(296): Pfam Name: CCT Pfam Desc: CCT motif
  misc_feature (1)..(46): Pfam Name: zf-B_box Pfam Desc: B-box zinc finger
  misc_feature: Functional Homolog Of SEQ ID NO. 20
MWVCEACERAPAAFLCKADAASLCITCDSDIHSAQPLARRHQRVPILPIPGMLCGTPSAPYPSGLVMGPTGVAAKIEFLTQDEDQTIHEEEDEDEAASWPLFNHVKNICNQSNNIGRFFGGEVDEYLDLDEYNSYQDNQFSNQDNNQLQPYDVSQKSYGSDNVVPIQYGKSKDQIHNHGFQLGREYEASKNVYDNPASISHTVSFSSLDVGVVPESTTSEVSVPHPRPPKGTIDLFSSPPIPMPTQLSPMDREARVLRYREKKKARKFEKTIRYASRKAYAETRPRIKGRFAKRTDVRANQMFSSTLIEEGGYGIVPSF

SEQ ID NO: 171 - DNA, 982 bp, Arabidopsis thaliana
  misc_feature: Ceres Clone ID no. 7088
  misc_feature: Encodes the peptide sequence at SEQ ID NO. 172
atagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttagaatcccgacggtgaacgagaattgctttgaaatggattttaccggaggatctaaaggctttgcttatggaggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactat

SEQ ID NO: 172 - protein, 314 aa, Arabidopsis thaliana
  misc_feature: Ceres Clone ID no. 7088
  misc_feature (1)..(314): Bit score of 334.7 for hmm based on sequences of FIGURE 2.
  misc_feature (1)..(48): Pfam Name: zf-B_box Pfam Desc: B-box zinc finger
  misc_feature (295)..(314): Pfam Name: CCT Pfam Desc: CCT motif
  misc_feature: Functional Homolog Of SEQ ID NO. 20
MASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFAYGGGYNCISHSVSSSSMEVGVVPDGGSVADVSYPYGGPATSGADPGTQRAVPLTSAEREARVMRYREKRKNRKFEKT

SEQ ID NO: 173 - protein, 350 aa, Populus x generosa
  misc_feature: Public GI ID no. 118489345
  misc_feature (1)..(350): Bit score of 491.6 for hmm based on sequences of FIGURE 2.
  misc_feature (1)..(48): Pfam Name: zf-B_box Pfam Desc: B-box zinc finger
  misc_feature (287)..(331): Pfam Name: CCT Pfam Desc: CCT motif
  misc_feature: Functional Homolog Of SEQ ID NO. 20
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGAAVNLLEDRYFDEVDGGRGDVSREEAEAESWLLPNPGGGTAKGVDSMDLNTGQYVFGSEMDPYLDLDPYVDPKVEVQEQNSSGTTDGVVPVQSNKLGFQAPALVNDNCCYELDFSTGSKSFGGGYGYNSLSHSVSSSSLDVGVVPDGSGSTLTDISNPYCSRSVSNGMESANQTVQLSAVDREARVLRYREKRKNRKFEKTIRYASRKAYAETRPRIKGRFAKRTDTEVEVDRSSLYGFGVVPSF

SEQ ID NO: 174 - DNA, 1549 bp, Panicum virgatum
  misc_feature: Ceres Clone ID no. 1769510
  misc_feature: Encodes the peptide sequence at SEQ ID NO. 175
ctccctccactacgccgcgcgcgctccctcccacccctcccctccaccaccacaagcaccgcgtcgacaccacctgccatcgccgcgccgagctcagcctctagctagctgcgccaggagggcgcccgcctcgctccctccctgccgacgccagtgcgatggagctgcataagtactggggcgtggggggccggcggtgcggcgactgcgaggcggccccggcggcggtgcactgccgctcgtgccccgccaccgccgggggcgcgttcctctgcgctgcgtgcgacgcgcgcccggggcacgcgcggctgggccacgagcgcgtgtggatgtgcgaggtctgcgagctggcccccgccgccgtcacctgcaaggccgacgccgccgtgctctgcgccgcctgcgacgccgacatccacgacgccaacccgctggcgcgccgccatgcgcgcgtccccgtcgcgcccatcgggtccgaggccgccgcctccgccgtcgaggccatgctgttcgggaccggcgacggcgacccggccgcgcccgaggccgaggagccgcaggacgcggcggccgggcacgggcacgggcagctccagcaccaccaccagcacgcgctgaacctcaacgtggaggccaaggacatgaagctggactacctcttctccgacctggacccctacctcagcgtcgacatcccgcgcttccagcacgccgacagcgtcgtccccagcggcgtcggcgccggagccgccgccggcgccgtcgagctggacttcacgtgcggcatcggcgtcaagccctcctcgtacagctcctacacggcaacatccttcgcccacagcggctcctcctctgaggtcggcgtggtgccggaggccttctgcggcggcggcgccgggaccttcgagctcgacttcacccggcccaagcctcaagcctacatgccgtacaccgcgactcctcagagccacagcgtgtcgtcggtggacgtggaggtggcggcggcggagcggggggacatggcggcggcgaggccggtgccgctggtgggggagagccgggaggcgcggctgatgcgctaccgggagaagcggaagaaccggcggttcgagaagaccatccggtacgcgtcccggaaggcctacgccgagacgcggccgcggatcaagggccggttcgccaagcgcgccgaccacgacgccgacgacgccgaggccgaggccgccgtgccgtcgccggcgtcgtacgtgctcgacttcggctacggcgtcgtgcccagcttctgatcgatcgacgacggtccggcgggcggcggcgcgcctgacccggcactggcgcgcgcgccttgtgtacttgtatcgatgcatgatgtataggggaggaatagtaaatcccatgtactactctctttttggagctgtgctagccttgcgcacgctagtgatgtataatttgtatactacgcgctgctacttactactagcatgttcttgctggaattagccccggctatttttgaatcaaatctatgcaagaaatttgtaacggt

SEQ ID NO: 175 - protein, 375 aa, Panicum virgatum
  misc_feature: Ceres Clone ID no. 1769510
  misc_feature (1)..(375): Bit score of 695.5 for hmm based on sequences of FIGURE 2.
  misc_feature (301)..(345): Pfam Name: CCT Pfam Desc: CCT motif
  misc_feature (54)..(101): Pfam Name: zf-B_box Pfam Desc: B-box zinc finger
  misc_feature: Functional Homolog Of SEQ ID NO. 20
MELHKYWGVGGRRCGDCEAAPAAVHCRSCPATAGGAFLCAACDARPGHARLGHERVWMCEVCELAPAAVTCKADAAVLCAACDADIHDANPLARRHARVPVAPIGSEAAASAVEAMLFGTGDGDPAAPEAEEPQDAAAGHGHGQLQHHHQHALNLNVEAKDMKLDYLFSDLDPYLSVDIPRFQHADSVVPSGVGAGAAAGAVELDFTCGIGVKPSSYSSYTATSFAHSGSSSEVGVVPEAFCGGGAGTFELDFTRPKPQAYMPYTATPQSHSVSSVDVEVAAAERGDMAAARPVPLVGESREARLMRYREKRKNRRFEKTIRYASRKAYAETRPRIKGRFAKRADHDADDAEAEAAVPSPASYVLDFGYGVVPSF

SEQ ID NO: 176 - protein, 336 aa, Chenopodium rubrum
  misc_feature: Public GI ID no. 170779038
  misc_feature (1)..(336): Bit score of 411.9 for hmm based on sequences of FIGURE 2.
  misc_feature (13)..(60): Pfam Name: zf-B_box Pfam Desc: B-box zinc finger
  misc_feature (267)..(311): Pfam Name: CCT Pfam Desc: CCT motif
  misc_feature: Functional Homolog Of SEQ ID NO. 20
MMKKEVPGGDNNSWARVCDTCRSAPCTVYCKEDSAFLCTSCDARIHAVNQVASRHERVWVCEACEREPAAFLCKADAASLCATCDADIHSANPLARRHHRVPIMPVGCVYGPSDGRMSEEGFLDLPDGDDQTTDHEGDEDEAASWLLLNPGADNQFCEQYSQQQEFSVPEKNCGGDSVVPVQCREVKDHQIQYQKFLFGMECETKSEYNYNTSISHSVSVSSLDVGVVPESTMSDMSVSHSRPPKGTIDLFSSPPMQVPTQLSPLDREARVMRYREKKKNRKFEKTIRYASRKAYAETRPRIKGRFAKRTDVEAEMDQMFTNSLMSDGGYGIVPSF

SEQ ID NO: 177 - DNA, 1357 bp, Panicum virgatum
  misc_feature: Ceres Clone ID no. 1996408
  misc_feature: Encodes the peptide sequence at SEQ ID NO. 178
aaaaacacccccgaggccaaccatttccgacgcaaaaccccccggaatccgtgacacccgcccggaggagagcagagcagaggcaccaggcatggacgccgcggtggagctggagctggagcagaagccggcggtggggtactggggcttggccggcgcgcggccctgcgacgcgtgcgccgcggaggcggcgcggctgcactgccgcgcggacggcgccttcctgtgccccgggtgcgacgcccgcgcgcacggcgccgggtcgcgccacgcgcgcgtctgtctctgcgaggtctgcgagcacgcccccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtcctcagccttcgccgccgcgggggtccaggcccagggggacgcggctgcggacgacgacgggagcaacgaggccgaggccgcctcgtggctcctccccgagcccgacaactgccacgaggacagcgccgccgccaccgacgccttcttcgctgactccgacgcgtacctcggcgtcgacctcgacttcgcccggtccatggacggcatcaaggccatcggcgtgccggtcgcgccgcccgagctggacatggccaccggcggttactactaccccgaacactccatgaaccacagcgtgtcgtcgtcggaggtggcggttgtgccggacgcgctggcgggcggcgccccggccgcgccggcggtgccggcggcgagccgggggaaggagcgggaggcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctcctccgcggaggccgaggccgaggacgaggcgctgctggagcacgaggaagcggcgtgcttctcgcccgcggcgtcggcgcccgcggcctcctcggacggcgtcgtcccgtcctgctgaggggacacgacgggcggcggccgcgcctcctcctcccaggctccccggcggcgaccccttaattttgccgactctgaatcgatcccaacgcatgcgaacatgcgatgcgatgcgcgctccgtgcagcacatgaataattgtacagtagttccacgaactcgatcgtggtcgcacggaatcgcatgtaatcctcctcaccgtccttgtaatccagccttgtacattaccgtctagaggtgtttgtgcttctctcgc

SEQ ID NO: 178 - protein, 336 aa, Panicum virgatum
  misc_feature: Ceres Clone ID no. 1996408
  misc_feature (1)..(336): Bit score of 649.8 for hmm based on sequences of FIGURE 2.
  misc_feature (254)..(298): Pfam Name: CCT Pfam Desc: CCT motif
  misc_feature (21)..(65): Pfam Name: zf-B_box Pfam Desc: B-box zinc finger
  misc_feature: Functional Homolog Of SEQ ID NO. 20
MDAAVELELEQKPAVGYWGLAGARPCDACAAEAARLHCRADGAFLCPGCDARAHGAGSRHARVCLCEVCEHAPAAVTCRADAAALCAACDADIHSANPLARRHERLPVAPFFGALADAPQPFPSSAFAAAGVQAQGDAAADDDGSNEAEAASWLLPEPDNCHEDSAAATDAFFADSDAYLGVDLDFARSMDGIKAIGVPVAPPELDMATGGYYYPEHSMNHSVSSSEVAVVPDALAGGAPAAPAVPAASRGKEREARLMRYREKRKNRRFDKTIRYASRKAYAETRPRIKGRFAKRCSSAEAEAEDEALLEHEEAACFSPAASAPAASSDGVVPSC

SEQ ID NO: 179 - DNA, 990 bp, Sorghum bicolor
  misc_feature: Ceres Annot ID no. 8701721
  misc_feature: Encodes the peptide sequence at SEQ ID NO. 180
atggagggcgacgagaagtcggcgggcggggccccggcgtactggggcctgggcgcgcggccctgcgacgcgtgcggcgccgatgcggcgcgcctctactgccgcgcggactcggcgttcctgtgcgccgggtgcgacgcgcgggcgcacggggccgggtcgcccaacgcgcgggtctggctctgcgaggtctgcgagcacgcgccggcggcggtcacgtgccgcgccgacgccgccgcgctctgcgcctcctgcgacgccgacatccactcggccaacccgctggcgcgacgccacgagcgcctccccgtggcgcccttcttcggcgcgctggccgacgcgcccaagcccttcgcctcgtcggcggcggccgtgccgcccaaagcgacggccggggccgacgacgacgggagcagcgaggccgaggcggcgtcgtggctcctccccgagcccgaccacgggcacaaagaagaaggcgccaccacggaggtgttcttcgcggactccgacccgtacctcgacctcgacttcgcgcgttccatggacgacatcaagaccatcggcgtccagggcgggccaccagagctcgacctcaacggcgccaagctcttctactccgaccactccatgaaccacagtgtgtcatcgtcggaggcagcggtggtgcccgacgcggcggctggcgcggcgcccgtggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgccgggggctggggaggacccgctggaggagcacgaggagatgtactcctcggccgcggcggccgtggctgcgctcatggcccccggcggagccgacgcggactacggcgtcgacggcgtcgtgcccacatattga

SEQ ID NO: 180 - protein, 329 aa, Sorghum bicolor
  misc_feature: Ceres Annot ID no. 8701721
  misc_feature (1)..(329): Bit score of 640.1 for hmm based on sequences of FIGURE 2.
  misc_feature (242)..(286): Pfam Name: CCT Pfam Desc: CCT motif
  misc_feature (57)..(104): Pfam Name: zf-B_box Pfam Desc: B-box zinc finger
  misc_feature: Functional Homolog Of SEQ ID NO. 20
MEGDEKSAGGAPAYWGLGARPCDACGADAARLYCRADSAFLCAGCDARAHGAGSPNARVWLCEVCEHAPAAVTCRADAAALCASCDADIHSANPLARRHERLPVAPFFGALADAPKPFASSAAAVPPKATAGADDDGSSEAEAASWLLPEPDHGHKEEGATTEVFFADSDPYLDLDFARSMDDIKTIGVQGGPPELDLNGAKLFYSDHSMNHSVSSSEAAVVPDAAAGAAPVVAVVSRGLEREARLMRYREKRKSRRFEKTIRYASRKAYAETRPRIKGRFAKRTPGAGEDPLEEHEEMYSSAAAAVAALMAPGGADADYGVDGVVPTY

SEQ ID NO: 181 - protein, 343 aa, Prunus persica
  misc_feature: Public GI ID no. 197726026
  misc_feature (1)..(343): Bit score of 521.0 for hmm based on sequences of FIGURE 2.
  misc_feature (1)..(48): Pfam Name: zf-B_box Pfam Desc: B-box zinc finger
  misc_feature (282)..(326): Pfam Name: CCT Pfam Desc: CCT motif
  misc_feature: Functional Homolog Of SEQ ID NO. 20
MASKLCDSCKSATATLFCRADSAFLCVNCDSKIHAANKLASRHARVWLCEVCEQAPAHVTCKADDAALCVTCDRDIHSANPLSRRHERVPVTPFYDSGNSAANSAPVVKSVVNFLDDRYFSDVDGQDAETEVSREEAEAASWLLPNPKAMENPDLNSGEYFLPEMDPYLDLDYGHVDPKLEDAQEQNSCGTDGVVPVQSKSVQPQLVNDHSFEIDFSAASKPYVYGFHAQCLSQSVSSSSMDVSVVPDGNTTMTDVCDPYTKSMSAAVESTHQAVQISSADREARVLRYREKRKNRKFEKTIRYASRKAYAETRPRIKGRFAKRTEVEIEAERLCRYGVVPSF

SEQ ID NO: 182 - protein, 343 aa, Brassica nigra
  misc_feature: Public GI ID no. 194244824
  misc_feature (1)..(343): Bit score of 289.3 for hmm based on sequences of FIGURE 2.
  misc_feature (7)..(54): Pfam Name: zf-B_box Pfam Desc: B-box zinc finger
  misc_feature (281)..(325): Pfam Name: CCT Pfam Desc: CCT motif
  misc_feature: Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNSENNRFSVGEEYLDLVDYSSSMDKRFTGQANQYQQDYNVPQRSYVADGVVPLQVGVSKGHMHHEQHNFQFGFTNVSSEAHQISNGSPIHMVSLVPESVTSDATVSHQRSPKSGTEELPEAPVQMLSPMERKARVLRYREKKKTRKFEKRIRYASRKEYAEKRPRIKGRFAKRNEVDADQAFPTVVMFDTGYG

SEQ ID NO: 183 - protein, 398 aa, Zea mays
  misc_feature: Public GI ID no. 158866355
  misc_feature (1)..(398): Bit score of 329.2 for hmm based on sequences of FIGURE 2.
  misc_feature (327)..(371): Pfam Name: CCT Pfam Desc: CCT motif
  misc_feature (27)..(74): Pfam Name: zf-B_box Pfam Desc: B-box zinc finger
  misc_feature: Functional Homolog Of SEQ ID NO. 20
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 184 - DNA, 1320 bp, Glycine max
  misc_feature: Ceres Clone ID no. 472076
  misc_feature: Encodes the peptide sequence at SEQ ID NO. 185
tcttcactctcagaacactaactcccccaatgttggagggccaagcaacaacgcccacgtggccgcgcatgtgcgacacgtgccgctccgtcccctccaccgtcttctgccgctcccacaccgcctttctctgcgccacgtgcgacactcgcctccacgtctcgctcacgtggcacgagcgcgtgtgggtgtgcgaggcgtgcgagcgcgccccggcggcgttcctctgcaaggccgacgccgcctccctctgcgcctcctgcgacgccgacatccacgccgccaaccccctcgccagccgccaccaccgcgtccccatcctccccatcgccgccgccaacaacaacaacaacgacgacgacgacgttgctgacgttgacgacgaagacgaaaccgcttcatggctcttgctcaaccctatcaagagtgctactgtccctaacaccaataacaataacaataataacgggttcttgtataacggtgaggttgatgagtatttggaccttgttgataattgtaactcttgtggtgataataatcacttcgcttcagctgctgctactactgatcattacgctcagcaccaacatttcgctggtgtttctcagaagagttatgctggggacagtgttgttccggttcagcaacaccagcattttcagcttgggttggactttgacaactccaaacctgccttcagttacaatggttctgttagtcaaagtgtttcagtttcatcaatggatattggtgttgtacctgaatcaccaatgagggatgtctcaattgcccatacaagaccccccaaagggacaattgacctattttctggacctccaattcaggtgccttcccatttttctccaatggacagggaggccagagtcctaaggtacagggagaaaaagaagatgagaaaatttgagaagacaatcaggtatgcctcaaggaaggcctatgcagagactagacctcgtataaaaggtcgatttgccaagagaacagatgtagaagctgaagtggatcagatgttctcgacaacactaattacagaagttggatatggaattgttccctctttctgaatatgctgtgtagaacaaatggccagaagacattgaagatgctagaggatcatgattaatagaaatggaaaccacttgtgtactaagttattctgctgataatgtattttttatgtaatctaattgcttgcagttgtactaatcggatgctttattattttgtttattgtcttttgaatgaaacttgtatttgtaaatacagtccttgtattaaattattaaattacagtcg

SEQ ID NO: 185 - protein, 352 aa, Glycine max
  misc_feature: Ceres Clone ID no. 472076
  misc_feature (1)..(352): Bit score of 378.3 for hmm based on sequences of FIGURE 2.
  misc_feature (283)..(327): Pfam Name: CCT Pfam Desc: CCT motif
  misc_feature (50)..(97): Pfam Name: zf-B_box Pfam Desc: B-box zinc finger
  misc_feature: Functional Homolog Of SEQ ID NO. 20
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNGEVDEYLDLVDNCNSCGDNNHFASAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 186 - protein, 321 aa, Brassica rapa subsp. campestris
  misc_feature: Public GI ID no. 33943521
  misc_feature (1)..(321): Bit score of 284.1 for hmm based on sequences of FIGURE 2.
  misc_feature (252)..(296): Pfam Name: CCT Pfam Desc: CCT motif
  misc_feature (46)..(93): Pfam Name: zf-B_box Pfam Desc: B-box zinc finger
  misc_feature: Functional Homolog Of SEQ ID NO. 20
MLKEESNESGGTRACDTCRSAACTIYREADSTYLCTTCDARVHAAKRVRVCDSCESAPAAFFCKADAASLCTACDAEIHSANPLARRHQRVPITSNSCGSMATDGDNNVMMVSEEKEDADEVASWLMLNPGKNNQNNGFLFGVEYLDLVDYSSSIDNQFEDQYSKYHRSFGGGEDGVVPLQLEESSTSHMQQSQHNFHLGVNYGYSTEPQYSYVSVVPESLSDTTVQHAKETIDQVCGPPTQMVQQLTPADREARVLRYREKKKRRKFEKTIRYASRKAYAEVRPRIKGRFAKRIDMEADAEQLFSTSVMSNTSYGIVPSF

SEQ ID NO: 187 - protein, 348 aa, Beta vulgaris subsp. vulgaris
  misc_feature: Public GI ID no. 186911830
  misc_feature (1)..(348): Bit score of 348.6 for hmm based on sequences of FIGURE 2.
  misc_feature (6)..(53): Pfam Name: zf-B_box Pfam Desc: B-box zinc finger
  misc_feature (313)..(348): Pfam Name: CCT Pfam Desc: CCT motif
  misc_feature: Functional Homolog Of SEQ ID NO. 20
MGGGLMAAKLCDSCKSATATIFCRADTAYLCISCDAKIHAANKLASRHARVWVCEVCEHAPATVTCKADAAHLCATCDRDIHSANPLARRHERVPLTPFYDPLSPPNTTNNNNDDSDSSATAAAAAKSAAINKLFGDEYYSDADEAEAASWLLPNPNKTDEPKSIDYLFSSSGNDGDDIDPYLDLDFGAEAKPDPDLSSDGVVPDPDQKGVHHHHLTTLQHPAASMFSLSSYHHHHHHHHVSNNNGHFDGFENSSAACKPFALSSYHTQPSLSHSVSSSSLDFGVVPDASNITDVASTGFDKQQQMKIIGMDREARVLRYREKRKNRKFEKTIRYASRKAYAETRPRI

SEQ ID NO: 188 - DNA, 1077 bp, Solanum lycopersicum
  misc_feature: Ceres Annot ID no. 8457547
  misc_feature: Encodes the peptide sequence at SEQ ID NO. 189
atgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaa

SEQ ID NO: 189 - protein, 358 aa, Solanum lycopersicum
  misc_feature: Ceres Annot ID no. 8457547
  misc_feature (1)..(358): Bit score of 531.8 for hmm based on sequences of FIGURE 2.
  misc_feature (8)..(55): Pfam Name: zf-B_box Pfam Desc: B-box zinc finger
  misc_feature (295)..(339): Pfam Name: CCT Pfam Desc: CCT motif
  misc_feature: Functional Homolog Of SEQ ID NO. 20
MGTENWSLTAKLCDSCKTSPATVFCRADSAFLCLGCDCKIHAANKLASRHARVWVCEVCEQAPASVTCKADAAALCVTCDRDIHSANPLARRHERFPVVPFYDFAVAKSHGGGDTDADAVDDEKYFDSTNENPSQPEEEAEAASWILPTPKEGTDQYKSADYLFNDMDSYLDIDLMSCEQKPHILHHQQHQHNHYSSDGVVPVQNNNETTHLPGPVVDGFPTYELDFTGSKPYMYNFTSQSISQSVSSSSLDVGVVPDHSTMTDVSNTFVMNSSSGAIAGAGADVVPNAVSGLDREARVMRYREKRKNRKFEKTIRYASRKAYAETRPRIKGRFAKRTETEIDSLITVDASYGVVPSF

SEQ ID NO: 190 - protein, 369 aa, Lolium perenne
  misc_feature: Public GI ID no. 188484477
  misc_feature (1)..(369): Bit score of 209.9 for hmm based on sequences of FIGURE 2.
  misc_feature (300)..(344): Pfam Name: CCT Pfam Desc: CCT motif
  misc_feature (22)..(69): Pfam Name: zf-B_box Pfam Desc: B-box zinc finger
  misc_feature: Functional Homolog Of SEQ ID NO. 20
MLMNCDFNCDLFEQEAKRRSYPWARPCDGCHAAPSAVYCHADAAYLCASCDTQVHSANRLASSHERVRVCVSCESAAAVLECHADSAALCTTCDAQVHSANPIAQRHQRVPVLPLPALAIPAASVFAEAEAATTVYGDKEEGEEVDSWLLLERDSDDNNCTNNIDQYFNLFGYDMYYDKFSCNPGPGEEYRLQEQDVQNMYRENEVCEFAVPSQVGMASEQPESSYGMIGAEQDASMTAGTSTYTASISNGIPFSSMEVGIIPDNTRPDVSNTNIQRTSEAMELAGHSLQMPVHFSSMDRDARVLRYKEKKQARTFQKTIRYATRKAYAEARPRIKGRFAKRSDIEHELDQMLTIPALPDSGHATVLWF

SEQ ID NO: 191 - DNA, 1131 bp, Sorghum bicolor
  misc_feature: Ceres Annot ID no. 8743875
  misc_feature: Encodes the peptide sequence at SEQ ID NO. 192
atggagctgcacaagtactggggcgtgggtggccggcggtgcggcagctgcgaggcggcgccggcggcggtgcactgccgcacgtgcgtcggcgggtcgtcgtcgttcctctgcacgacgtgcgacgcgcgccccgcgcacgcgcgcctggcccacgagcgcgtgtgggtgtgcgaggtctgcgagctggcccccgccgccgtcacgtgcaaggccgacgccgccgtgctctgcgccgcctgcgacgccgacatccacgacgccaacccgctggcgcgccgccacgcgcgggtccccgtcgcgcccatcggctccgaggccgccgccgcggccgtcgaggccatgctgttcgggaccggcgacgcggccgaggccgacgaccagcacaacaacgcggcggcggcggccgagcagcatcagcatcagcaccacgctcaccacgcgcacgcgctgaacctcaacgtggaggcgaaggacatgaagctggactacctcttctctgagctggatccctacctcagcgtcgagatcccgcgcttccaccacgccgacagcgtcgtccccaacggcgccggcgctgccggcgccgtcgagctcgacttcacgtgcggcatcggcgtcaagcactcctcctacagctcctacaccgccacctccctcgatctcgcgcatagcggctcctcgtcggaggtcggcgtggtgccagaggccttcggcggcggcggcggcggcggcggcgggagctttgagctcgacttcacaaggccaaagcctcaggcctacatgccatacacggcgactccccagagccacagcgtgtcgtccgtggacgtggaggtggtgccggagcggggagacttgccggcggtgaggccggtgccgctgatgggggagagccgggaggcgcggctgatgcggtaccgtgagaagaggaagaaccggcggttcgagaagaccatccggtacgcgtcccggaaggcctacgccgagacgcggccgcggatcaaggggaggtttgccaagcgcgccgaccacgacggcgacggcgacgccgacgacgccgaggccgaggccgccgtgccgtcgtcgtacgtgctcgacttcggctacggcgtcgtgccgagcttctga

SEQ ID NO: 192 - protein, 376 aa, Sorghum bicolor
  misc_feature: Ceres Annot ID no. 8743875
  misc_feature (1)..(376): Bit score of 743.4 for hmm based on sequences of FIGURE 2.
  misc_feature (300)..(344): Pfam Name: CCT Pfam Desc: CCT motif
  misc_feature (53)..(100): Pfam Name: zf-B_box Pfam Desc: B-box zinc finger
  misc_feature: Functional Homolog Of SEQ ID NO. 20
MELHKYWGVGGRRCGSCEAAPAAVHCRTCVGGSSSFLCTTCDARPAHARLAHERVWVCEVCELAPAAVTCKADAAVLCAACDADIHDANPLARRHARVPVAPIGSEAAAAAVEAMLFGTGDAAEADDQHNNAAAAAEQHQHQHHAHHAHALNLNVEAKDMKLDYLFSELDPYLSVEIPRFHHADSVVPNGAGAAGAVELDFTCGIGVKHSSYSSYTATSLDLAHSGSSSEVGVVPEAFGGGGGGGGGSFELDFTRPKPQAYMPYTATPQSHSVSSVDVEVVPERGDLPAVRPVPLMGESREARLMRYREKRKNRRFEKTIRYASRKAYAETRPRIKGRFAKRADHDGDGDADDAEAEAAVPSSYVLDFGYGVVPSF

SEQ ID NO: 193 - protein, 444 aa, Picea abies
  misc_feature: Public GI ID no. 193735598
  misc_feature (1)..(444): Bit score of 405.5 for hmm based on sequences of FIGURE 2.
  misc_feature (377)..(421): Pfam Name: CCT Pfam Desc: CCT motif
  misc_feature (79)..(126): Pfam Name: zf-B_box Pfam Desc: B-box zinc finger
  misc_feature: Functional Homolog Of SEQ ID NO. 20
MVKEEDKDWHTVEDLHRGSHVDHKEFLRGIGGWRMSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 194 - protein, 384 aa, Picea sitchensis
  misc_feature: Public GI ID no. 116787635
  misc_feature (1)..(384): Bit score of 467.1 for hmm based on sequences of FIGURE 2.
  misc_feature (23)..(70): Pfam Name: zf-B_box Pfam Desc: B-box zinc finger
  misc_feature (320)..(364): Pfam Name: CCT Pfam Desc: CCT motif
  misc_feature: Functional Homolog Of SEQ ID NO. 20
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDHDDDDEIYAAEAASWLLPNPKSSAEGTKNCDDGGSCFGVDAGPPVNKAAGGYFSVVDLFPDVDPYLDLDYASPLEATGGTDSVVPVQSNVSSQDGAVSTPSDCFDTEKVTYSYTTTTSLSHSVSSSSLDVGVVPDATLSDMPRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 195 - protein, 383 aa, Triticum aestivum
  misc_feature: Public GI ID no. 169807976
  misc_feature (1)..(383): Bit score of 230.7 for hmm based on sequences of FIGURE 2.
  misc_feature (314)..(358): Pfam Name: CCT Pfam Desc: CCT motif
  misc_feature (19)..(66): Pfam Name: zf-B_box Pfam Desc: B-box zinc finger
  misc_feature: Functional Homolog Of SEQ ID NO. 20
MNCVSNGTVYEEAVGREGSWARLCDGCCTVPSVVYCRADSAYLCASCDAQIHAANRVASRHERVLLSEAYKHAPVVLECHADAAALCAAYEAQVHYANLLATMHQRVPVVSHPVAAIPAASLFAEAAATAPVLGSKEEDASWLLLSKDSDNHNHSGNHSSSSSSSRYFGEVDQYFDLVGYNSYYDSHMNNQEQYVMQEQQHLQQMQKEYAEQQMQKEYVEKEGSECIVPSQSAIVSRPHQSGYAPLVRAEQAASVTAGVSAYTDSVNNSISFSMEAGIVPDNTVQSSILRPAGAIGHFSSPSLQTPLHFSSKEREARVLRYKEKKKSRKFEKTTRYATRKAYAEARPRIKGRFAKRSDADMEVDQTFSTAALSDSSYSTVPWF

SEQ ID NO: 196 - protein, 397 aa, Zea mays
  misc_feature: Public GI ID no. 157422228
  misc_feature (1)..(397): Bit score of 334.9 for hmm based on sequences of FIGURE 2.
  misc_feature (326)..(370): Pfam Name: CCT Pfam Desc: CCT motif
  misc_feature (27)..(74): Pfam Name: zf-B_box Pfam Desc: B-box zinc finger
  misc_feature: Functional Homolog Of SEQ ID NO. 20
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEATATAASVAGDKDEEVDSWLLLTKDPDDDDKNHNCSSNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISYSSSMEVGIVPDNMATTDMPSSGILLTPAGAISLFSSGPPLQMPLHLASMDREARVLRYREKKKSRKFEKTIRYATRKTYAEARPRIKGRFAKRSSDMDDEVDQMFSAAALSSDGSYGTVPWF

SEQ ID NO: 197 - DNA, 1423 bp, Panicum virgatum
  misc_feature: Ceres Clone ID no. 1755159
  misc_feature: Encodes the peptide sequence at SEQ ID NO. 198
gcgcgctccctcccctcccctcctcccaccagcccaccaccaccacaagcaccgcgtcgtccacaccacctgccattgccgcgccgagctcagcctctagctgcgccaggagggcgcccgcctccctccctgccgacgccggtgtgatggagctgcacaagtactggggcgtggggggccgccggtgcggcggctgcgaggcggccccggcggcggtgcactgccgctcgtgccccgccgggggcgcgttcctctgcacggcgtgcgacgcgcgcccggggcacgcgcatctgggccacgagcgcgtgtggatgtgcgaggtctgcgagctggcgcccgccgccgtcacgtgcaaggccgacgccgccgtgctctgcgccgcctgcgacgccgacatccacgacgccaacccgctggcgcgccgccacgcacgcgtccccgtcgcgcccatcggctcggaggccgcggccgccgccgtggaggccatgctgttcgggaccggcgagccggccgcgtccgaggccgaggagccgcagaacgcggcggccaggcacaaccaccagcacgcgctgaacctcaacgtggaggccaaggacatgaagctggactacctcttttccgacctggacccctacctcagcgtcgatatcccgcgcttccagcacgccgacagcgtcgtccccagcggcgtcggcgccggagcagccggcgccgtcgagctggacttcacgtgcggcatcggcgtcgagccctcctcatacagctcctacacggcaacatccctcgcccacagcggctcctcttctgaggtcggcgtggtgccagaggccttctgcggcggcggcgggagcttcgagctcgacttcacaaggcccaagcctcaagcctacatgccgtacaccgcgactcctcaaagtcacagcgtgtcgtcggtggacgtggaggtggtgccggagcggggggacatgatggcggcggcgaggccggtgccgctggtgggggagagccgggaggcgcggctgatgcgctaccgggagaagcggaagaaccggcggttcgagaagaccatccggtacgcgtcccggaaggcctacgccgagatgcggccgcggatcaagggccggttcgccaagcgcgccgaccacgacgccgacgccgacgacaccgaggccgaggccgaggccgccgtgccgtcgccggcgtcgtacgtgctcgacttcggctacggcgtcgtgcccagcttctgatcgacgacgatcgtctcgctcgttccacgcgcggcgcgcttgacccggcccggcgcgcgcgccttgtacttgtatcgatgcatgtataggggaggaatagtaatcccatgtactctcgtcttggagctgcgctagccctgcgtacgtacgctagtgatgtataatttgtacaaccc

SEQ ID NO: 198 - protein, 366 aa, Panicum virgatum
  misc_feature: Ceres Clone ID no. 1755159
  misc_feature (1)..(366): Bit score of 709.8 for hmm based on sequences of FIGURE 2.
  misc_feature (288)..(332): Pfam Name: CCT Pfam Desc: CCT motif
  misc_feature (52)..(99): Pfam Name: zf-B_box Pfam Desc: B-box zinc finger
  misc_feature: Functional Homolog Of SEQ ID NO. 20
MELHKYWGVGGRRCGGCEAAPAAVHCRSCPAGGAFLCTACDARPGHAHLGHERVWMCEVCELAPAAVTCKADAAVLCAACDADIHDANPLARRHARVPVAPIGSEAAAAAVEAMLFGTGEPAASEAEEPQNAAARHNHQHALNLNVEAKDMKLDYLFSDLDPYLSVDIPRFQHADSVVPSGVGAGAAGAVELDFTCGIGVEPSSYSSYTATSLAHSGSSSEVGVVPEAFCGGGGSFELDFTRPKPQAYMPYTATPQSHSVSSVDVEVVPERGDMMAAARPVPLVGESREARLMRYREKRKNRRFEKTIRYASRKAYAEMRPRIKGRFAKRADHDADADDTEAEAEAAVPSPASYVLDFGYGVVPSF

SEQ ID NO: 199 - protein, 362 aa, Chenopodium rubrum
  misc_feature: Public GI ID no. 170779036
  misc_feature (1)..(362): Bit score of 423.2 for hmm based on sequences of FIGURE 2.
  misc_feature (13)..(60): Pfam Name: zf-B_box Pfam Desc: B-box zinc finger
  misc_feature (297)..(341): Pfam Name: CCT Pfam Desc: CCT motif
  misc_feature: Functional Homolog Of SEQ ID NO. 20
MMKKEVPGGDNNSWARVCDTCRSAPCTVYCKEDSAFLCTSCDARIHAVNQMASRHERVWVCEACEREPAAFLCKADAASLCATCDADIHSANPLARRHHRVPIMPVGCVYGPSDGRMSEDGFLDLPDRDDQTTDHEGDEDEAASWLLLNPGKNSNNQTTNGFLTGGGEVDEYLDLFEYNSGADNQFCEQYNQQQEFSVPEKNCGGDSVVPVQCREVKDHQIQYQNFLFGMECETKSEYTYNTSISHSVSVSSLDVGVVPESTMSDMSVSHSRPPKGTIDLFSSTPMQVPTQLSPLDREARVMRYREKKKNRKFEKTIRYASRKAYAETRPRIKGRFAKRTDVEAERTNSLMSDGGYGIVPSF

SEQ ID NO: 200 - DNA, 1116 bp, Oryza sativa
  misc_feature: Ceres Annot ID no. 1731456
  misc_feature: Encodes the peptide sequence at SEQ ID NO. 201
atgatggagttgcgcaagtactggggcgtcggcgggcggcggtgcggtgcgtgcgaggcgtcgccggcggccgtgcactgccgcggctgcggcggggtgtacctgtgcacggcgtgcgacgcgcgcccgggccacgcgcgggcggcgcacgagcgggtgtgggtgtgcgaggtctgcgaggtggcgcccgccgccgtcacctgcaaggccgacgccgcggtgctctgcgccgcctgcgacgccgacatccacgacgccaacccgctggcccgccgccacgcgcgcgtccccgtcgcgcccatcggctccgccgccgccgccgccgtggccgccgaggccatgctgttcggcgtcgccgccgccggggccgaggccgaggcggtggaggataaggccgcggccgagcaccaccaccaccagcagcggcagcagcacggcgcgctcaacctcaacgtggaggcgaaggacatgaagctcgactacctcttctccgacctcgacccttacctcaacgtcgagttcgcccgcttcccccacgccgacagcgtcgtccccaacggcgccggcgccggcgccgccatagagctcgacttcacctgcggcctaggcgtcggcgtcggcggcgccaagcagtcctacagctcctacaccgccaccgacctcgctcacagcggctcgtcgtcggaggtgggcgtggtgccggaggccatgtgcggcggcggcggcgccatcgatctcgacttcacgaggccgaagcctcaaccctacatgccgtacacggcgactcctcctccgagccacagcgtagtaagcgcgcagatgtcgtcgtcggtggtcgacgtgggcgtggtgccggagcgggcggcggcgatgggggaagggagggaggcgaggctgatgaggtacagggagaagcggaagaaccggcggttcgagaagacgatccggtacgcgtcgcgcaaggcctacgccgagacgcgcccccggatcaagggccgcttcgccaagcgcgccgaccacgacgccgacgacgccgacgccgacgccgacgaccccgccgccgtcccatcctcctacatgctcgacttcggctacggcgtcgtcccgtccttctga

SEQ ID NO: 201 - protein, 371 aa, Oryza sativa
  misc_feature: Ceres Annot ID no. 1731456
  misc_feature (1)..(371): Bit score of 611.8 for hmm based on sequences of FIGURE 2.
  misc_feature (295)..(339): Pfam Name: CCT Pfam Desc: CCT motif
  misc_feature (51)..(98): Pfam Name: zf-B_box Pfam Desc: B-box zinc finger
  misc_feature: Functional Homolog Of SEQ ID NO. 20
MMELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEDKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 202 - DNA, 1251 bp, Panicum virgatum
  misc_feature: Ceres Clone ID no. 1770031
  misc_feature: Encodes the peptide sequence at SEQ ID NO. 203
agcgagctcccggcgcgcgataatggagggtgacgagaagtcggcaggcggggccccggccccggcctactggggcctgggcgcgcggccctgcgacgcgtgcggcgacgaggcggcgaggctctactgccgcgcggacgcggcgttcctctgcgccgggtgcgacgcgcgcgcgcacggcgccgggtcgcgccacgcccgcgtctggctctgcgaggtctgcgagcacgcgccggccgcggtcacgtgccgcgcggacgccgccgcgctctgcgcctcgtgcgacgccgacatccactccgccaacccgctcgcgcgccgccacgagcgccaggccgtggcgcccttctacggcgcgctggccgacgcgcccaagcccttcgcctcgtcggcggccgtgcccaaagcggccgacgacgacgggagcaacgaggccgaggcggcgtcgtggctcctccccgagcccgaccacgggctcaaggaaggcgccacgacggaggtgttcttcgcggactccgacccgtacctcgacctcgacttcgcgcgcaccatggacgacatcaaggccatcggcgtccagaacggccccgccgagctcgacctcaccggcgccaagctcttctactccgaccactccatgaaccacagcgtgtcgtcatcggaggcagcagtggtgcccgacgcggcggcgggcgcggcgcccgtggttccagtggtgagcaggggtctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcacccccgggcccggcggcgcggacggggaggacccgctggaggagcacgaggaggagatgtactcctccgccgcggcagccgtggccgcgctcatggtccccggcggcgccgacgccgactacggcgtcgtgcccacgtattgatcggcgccggcctgttgtaacactagccagcctcgacctcgccgccggggctgtaatttttgctgcatgccctgcatgcaaagctgccgtgtagcattaattacctgtaatatgattccacggaagccatcaggccggacttccaagctattcttcctccctaatcattccgccatgtatgtatattattatgagtaaattgcactcatcatacaataaattgacagatagatacaaattgatcc

SEQ ID NO: 203 - protein, 327 aa, Panicum virgatum
  misc_feature: Ceres Clone ID no. 1770031
  misc_feature (1)..(327): Bit score of 643.2 for hmm based on sequences of FIGURE 2.
  misc_feature (238)..(282): Pfam Name: CCT Pfam Desc: CCT motif
  misc_feature (19)..(63): Pfam Name: zf-B_box Pfam Desc: B-box zinc finger
  misc_feature: Functional Homolog Of SEQ ID NO. 20
MEGDEKSAGGAPAPAYWGLGARPCDACGDEAARLYCRADAAFLCAGCDARAHGAGSRHARVWLCEVCEHAPAAVTCRADAAALCASCDADIHSANPLARRHERQAVAPFYGALADAPKPFASSAAVPKAADDDGSNEAEAASWLLPEPDHGLKEGATTEVFFADSDPYLDLDFARTMDDIKAIGVQNGPAELDLTGAKLFYSDHSMNHSVSSSEAAVVPDAAAGAAPVVPVVSRGLEREARLMRYREKRKSRRFEKTIRYASRKAYAETRPRIKGRFAKRTPGPGGADGEDPLEEHEEEMYSSAAAAVAALMVPGGADADYGVVPTY

SEQ ID NO: 204 - protein, 345 aa, Brassica nigra
  misc_feature: Public GI ID no. 194244874
  misc_feature (1)..(345): Bit score of 278.5 for hmm based on sequences of FIGURE 2.
  misc_feature (7)..(54): Pfam Name: zf-B_box Pfam Desc: B-box zinc finger
  misc_feature (283)..(327): Pfam Name: CCT Pfam Desc: CCT motif
  misc_feature: Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEAHQISNGSPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 205 - protein, 384 aa, Picea abies
  misc_feature: Public GI ID no. 150014754
  misc_feature (1)..(384): Bit score of 466.3 for hmm based on sequences of FIGURE 2.
  misc_feature (23)..(70): Pfam Name: zf-B_box Pfam Desc: B-box zinc finger
  misc_feature (320)..(364): Pfam Name: CCT Pfam Desc: CCT motif
  misc_feature: Functional Homolog Of SEQ ID NO. 20
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDDDEDDEIYAAEAASWLLPNPKSSAEGAKNCDDGGSCFGVDAGPPVNKAAGGYFSVVDLFPDVDPYLDLDYASPLEATGGTDSVVPVQSNVSSQDGAVSTPSDCFDTEKATYSYTTTTSLSHSVSSSSLDVGVVPDATLSDMSRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 206 - protein, 340 aa, Brassica nigra
  misc_feature: Public GI ID no. 194244844
  misc_feature (1)..(340): Bit score of 276.3 for hmm based on sequences of FIGURE 2.
  misc_feature (7)..(54): Pfam Name: zf-B_box Pfam Desc: B-box zinc finger
  misc_feature (280)..(324): Pfam Name: CCT Pfam Desc: CCT motif
  misc_feature: Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTG

SEQ ID NO: 207 - protein, 340 aa, Malus x domestica
  misc_feature: Public GI ID no. 189014382
  misc_feature (1)..(340): Bit score of 510.4 for hmm based on sequences of FIGURE 2.
  misc_feature (1)..(48): Pfam Name: zf-B_box Pfam Desc: B-box zinc finger
  misc_feature (279)..(323): Pfam Name: CCT Pfam Desc: CCT motif
  misc_feature: Functional Homolog Of SEQ ID NO. 20
MALKLCDSCKSATGTLFCRADSAFLCVNCDSKIHAANKLASRHARVWLCEVCEQAPAHVTCKADDAALCVTCDRDIHSANPLSRRHERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 208 - protein, 386 aa, Solanum lycopersicum
  misc_feature: Public GI ID no. 186915025
  misc_feature (1)..(386): Bit score of 486.0 for hmm based on sequences of FIGURE 2.
  misc_feature (307)..(351): Pfam Name: CCT Pfam Desc: CCT motif
  misc_feature (22)..(63): Pfam Name: zf-B_box Pfam Desc: B-box zinc finger
  misc_feature: Functional Homolog Of SEQ ID NO. 20
MGIFREAPNCFPGGWNIGAAARMAKSCEYCHLAAALVFCRTDNTFVCLSCDTRLHARHERVWVCEVCEQAAASVTCRADAAALCVACDRDIHSANPLARRHERVPVVPFYDPVESVVKSTAATLLVSINGTTTTATTTATITPELGKVDTCIGHHENNNDPWIPPNTITSKLPLNTEMKGMDFIFTDSENFLDFDYPACVDTQSQPHYNSSNDSVVPVQANTPIKSLPFHHQEKHFEIDFTQSHIKSYNTPSLSVSSSSLDVGIVPDGSSISEISYPYIRTMNNSNSSIDLSNSANHQGEKLLGLDREARVLRYREKKKNRKFEKTIRYASRKAYAETRPRIKGRFAKRTDGSAGAGEFDDVDGIFSGTDFIAAESRYGVVPSFLT

SEQ ID NO: 209 - DNA, 772 bp, Zea mays
  misc_feature: Ceres Clone ID no. 100941305
  misc_feature: Encodes the peptide sequence at SEQ ID NO. 210
gatggagggtgacgagaagtcggcgggcggggcccctgcttactggggcctgggcgcgcggccctgcgacgcgtgcggcgccgaggcggcgcgcctctactgccgcgcggacgcggcgttcctgtgcgccgggtgcgacgcgcgggcgcacggcgccgggtcgcgccacgcgcgggtctggctctgcgaggtctgcgagcacgcgccggcggcggtcacgtgccgcgcggacgctgccgcgctctgcgcctcctgcgacgccgacatccactcggcgaacccgctcgcgcgccgccacgagcgcctccacgtggcgcccttcttcggcgcgctggccgacgcgcccaagcccttcgcctcggcggcgccgcccaaagcaaccgacgacgacgggagcaacgaggacgaggcggcgtcgtggctcctccccgagcccgaccacgggcagaaagaaggcgccacgacggaggtgttcttcgcggactctgacccgtacctcgacctcgacttcgcgcgttccatggacgaaatcaagaccatcggcgtccagcagagcgggtcaccagagctcgacctcgccggcaccaagctcttctactccgatcactccgtgaaccacagtgtgtcatcgtcggaggcagcggttgtgcccgacgcggcgtctggcatggcgcccatggtggcagtggtcagcaggggcctggagcgagaggcgcggctgatgcggtaccgggagaagcgcaagagcaggcggttcgagaagacgatccgg

SEQ ID NO: 210 - protein, 257 aa, Zea mays
  misc_feature: Ceres Clone ID no. 100941305
  misc_feature (1)..(257): Bit score of 429.2 for hmm based on sequences of FIGURE 2.
  misc_feature (17)..(61): Pfam Name: zf-B_box Pfam Desc: B-box zinc finger
  misc_feature (236)..(257): Pfam Name: CCT Pfam Desc: CCT motif
  misc_feature: Functional Homolog Of SEQ ID NO. 20
MEGDEKSAGGAPAYWGLGARPCDACGAEAARLYCRADAAFLCAGCDARAHGAGSRHARVWLCEVCEHAPAAVTCRADAAALCASCDADIHSANPLARRHERLHVAPFFGALADAPKPFASAAPPKATDDDGSNEDEAASWLLPEPDHGQKEGATTEVFFADSDPYLDLDFARSMDEIKTIGVQQSGSPELDLAGTKLFYSDHSVNHSVSSSEAAVVPDAASGMAPMVAVVSRGLEREARLMRYREKRKSRRFEKTIR

SEQ ID NO: 211 - protein, 358 aa, Vitis vinifera
  misc_feature: Public GI ID no. 157341339
  misc_feature (1)..(358): Bit score of 452.0 for hmm based on sequences of FIGURE 2.
  misc_feature (289)..(333): Pfam Name: CCT Pfam Desc: CCT motif
  misc_feature (18)..(65): Pfam Name: zf-B_box Pfam Desc: B-box zinc finger
  misc_feature: Functional Homolog Of SEQ ID NO. 20
MLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPVLPIAGCLYGPPATDPGGTVTIDEEDEDEAASWLLLNPVKNNNGSSNNQNNGLLFGGEVDEYLDLVEYNSCPENQFSDQYNQQQPPPHYSVPHKNYGGDRVVPVQCGEAKGQLHQQHQQQGFHLGMDHSVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 212 - protein, 338 aa, Vitis vinifera
  misc_feature: Public GI ID no. 157327254
  misc_feature (1)..(338): Bit score of 612.5 for hmm based on sequences of FIGURE 2.
  misc_feature (1)..(48): Pfam Name: zf-B_box Pfam Desc: B-box zinc finger
  misc_feature (271)..(315): Pfam Name: CCT Pfam Desc: CCT motif
  misc_feature: Functional Homolog Of SEQ ID NO. 20
MASKLCDSCKSAPPTLFCRADSAFLCVACDSKVHAANKLASRHARVWMCEVCEQAPAHVTCKADAAALCVTCDRDIHSANPLARRHERVPVVPFYDSAAAAAKSNAVNLLVDDRYYSDPDGDASREEAEAASWLLPNPNPKLAESSDLNSSHYMFSDIDPYLDLDYPSMDPKLQSQQQQQSSGTDGVVPVQNKSVQAPLVNDNCFDMDFSGSKSFYNGQSLSQSVSSSSLEVGVVPDGNAMVDVTNPFGRSMNTGSESANQTAQISSGIDREARVLRYREKRKNRKFEKTIRYASRKAYAETRPRIKGRFAKRSEIEVDYSSSGALTADSGYGVVPSF

SEQ ID NO: 213 - protein, 395 aa, Zea mays
  misc_feature: Public GI ID no. 187830112
  misc_feature (1)..(395): Bit score of 326.8 for hmm based on sequences of FIGURE 2.
  misc_feature (324)..(368): Pfam Name: CCT Pfam Desc: CCT motif
  misc_feature (27)..(74): Pfam Name: zf-B_box Pfam Desc: B-box zinc finger
  misc_feature: Functional Homolog Of SEQ ID NO. 20
MDYNFDTSVLDEDVAGRGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 214 - protein, 317 aa, Medicago sativa
  misc_feature: Public GI ID no. 110277457
  misc_feature (1)..(317): Bit score of 385.4 for hmm based on sequences of FIGURE 2.
  misc_feature (1)..(48): Pfam Name: zf-B_box Pfam Desc: B-box zinc finger
  misc_feature (256)..(300): Pfam Name: CCT Pfam Desc: CCT motif
  misc_feature: Functional Homolog Of SEQ ID NO. 20
MATKLCDSCKSSKATLFCRSDSAFLCLTCDSNIHAANKLASRHHRVTLCQVCEQAPAHVTCKADAAALCISCDHDIHSANPLARRHERVPLTTFHHHNNNSQQQSFFSENDHDATNEEAGAASWLLQTPSNPKFPDLNYSHYSYPEIDDFVTVNAKTDTPEQNSPGTTADGVVPVQSQSKTTTEHQHEHYSDINIDFSNSKPFTYNFNHTVSSPSMEVGVVPDGNVMTEISYCGYQTTATETAPMTVAVPMTAVEREARVSRYREKRKNRKFEKTIRYASRKAYAETRPRIKGRFAKRSDLNMNLIAEDEYGVVPSC

SEQ ID NO: 215 - DNA, 1290 bp, Sorghum bicolor
  misc_feature: Ceres Annot ID no. 8736698
  misc_feature: Encodes the peptide sequence at SEQ ID NO. 216
atggcaaaggatctgccgatgatgcaaaggaggagtctggaagctgccggtcgttatgtggaggagtttcgctccaacgctctcgacgaggaggaggtcgctggaagaggcggggaaggagggagctgcgccgcagcaccagcatgggccaggccctgcgacgggtgccgggcggcgcccagcgtggtgtactgccacgccgacgcggcgtacctgtgcgcgtcgtgcgacgtgcgggtgcacgccgccaaccgcgttgcgtcgcgccacgagcgcgtgcgcgtgtgcgaggcctgcgagcgcgcgccagcagtgctggcgtgccgcgccgacgccgccgcgctctgcgtcgtctgcgacgcgcaggtccactccgcgaacccgctggccgggaggcaccagcgcgtgcccgtgctgccgctccccgtcgcggccatcccggctgcttccgtgctcgccgaggctgcggccaccgccgtggccgtgggtgacaagcaggaagaggaggtggactcgtggctgctgctcaccaacaccaaggatccagtttcagacaacaacaactgcaactgcagcagcagcagcaacaacaacatcagcagcagcaacaccagcaccttctacgcggatgttgatgagtactttgatctcgtgggctacaattcctactgtgacaaccacatcaacagcaacccaaagcagtacgggatgcaagaacgacagcaacagcagcagctgctgctgcaaaaggaatttggagacaaggagggaagcgagcacgttgtgcctgcttcacaggtcgcgatggcaaatgagcagcagcagagtggttatggagttattggggtagagcaggctgcctccatgactgccgcggtcagtgcttacacagattccatcactaacagcatatctttctcatcatcaatggaggtgggtatagtcccagacaacatggcaacgacgacagacatgccaaactccggcatcctgctgacacctgctgaggccatcagcctcttctcgtcaggttcttcgcttcagatgccactccacttgacctccatggacagagaggccagggtcctcaggtacaaggagaagaagaagagcagaaagttcgcgaagaccatacgatatgcgacgaggaagacatatgcagaagcaaggccgaggatcaagggccgcttcgccaagagatcttctgatatggaaatcgaagtggaccagatgttctcatctgcagctctgtcgtctgatggtagctacggtacggttctatggttctga

SEQ ID NO: 216 - protein, 429 aa, Sorghum bicolor
  misc_feature: Ceres Annot ID no. 8736698
  misc_feature (1)..(429): Bit score of 297.5 for hmm based on sequences of FIGURE 2.
  misc_feature (358)..(402): Pfam Name: CCT Pfam Desc: CCT motif
  misc_feature (48)..(95): Pfam Name: zf-B_box Pfam Desc: B-box zinc finger
  misc_feature: Functional Homolog Of SEQ ID NO. 20
MAKDLPMMQRRSLEAAGRYVEEFRSNALDEEEVAGRGGEGGSCAAAPAWARPCDGCRAAPSVVYCHADAAYLCASCDVRVHAANRVASRHERVRVCEACERAPAVLACRADAAALCVVCDAQVHSANPLAGRHQRVPVLPLPVAAIPAASVLAEAAATAVAVGDKQEEEVDSWLLLTNTKDPVSDNNNCNCSSSSNNNISSSNTSTFYADVDEYFDLVGYNSYCDNHINSNPKQYGMQERQQQQQLLLQKEFGDKEGSEHVVPASQVAMANEQQQSGYGVIGVEQAASMTAAVSAYTDSITNSISFSSSMEVGIVPDNMATTTDMPNSGILLTPAEAISLFSSGSSLQMPLHLTSMDREARVLRYKEKKKSRKFAKTIRYATRKTYAEARPRIKGRFAKRSSDMEIEVDQMFSSAALSSDGSYGTVLWF

SEQ ID NO: 217 - DNA, 1125 bp, Sorghum bicolor
  misc_feature: Ceres Annot ID no. 8671780
  misc_feature: Encodes the peptide sequence at SEQ ID NO. 218
atggaggccctggtggcggggaggtactggggtgtcgggggacggcggtgcgaggcgtgcgggggctcgccggcggcggtgcactgccggacgtgcccgggcggcggggcgtacctgtgcgcggggtgcgacgcgggccacgcgcgggccgggcacgagagggtgtgggtgtgcgaggtgtgcgagcgcgcgccggccgccgtcacgtgccgcgccgacgcggccgcgctctgcgccgcgtgcgacgccgacatccacgacgcgaacccgctggcgcgccgccacgagcgcgtgcccgtgcagcccatcggcgcggccgcggccgcgcccgccgcggagacgctgctgttcggcgccgccgcggaagagaatcaggacgacgacgacggcgccgccgcggcggctaaggtcgtcggcgtcgacgccggtaagctggcggacttcctgttcgcggacgtcatggacccgttcttcggccaagacttcactggtggcaccaggttcccgcacgccgacagcgttgtgcctaaccagggatcctgcggcgccgtcgctgccaagccgtcctacagctcctacaccgcggcgtcgctcggccacagcggctcgtcgtcggaggtcggcctggtcccagacgcgatgtgcggccgcggcgggagcgtgaccggcggcgtcatcgagctcgacttcgcgcagtccaaggccgcctacctgccttacgctgcaactccgacccacagtatgtcatctttggacgtgggtgcggtgccggaacgcggtgacggggtcatggcgggcagggtcgcgacgccgccggcggcggcggccgcggagagcagggaggcgcggctgatgcggtaccgcgagaagcggaagaaccggcggttcgagaagacgatccgctacgcgtcccggaaggcctacgcggagtcgcggccgcgcatcaagggccgcttcgcgaagcgcgcggacgacaacgacgccgacgccgacgccgacttcgacttcgacgcgggtgccgcggcggcgacggcgccggcgcggtcgcggtcgcagcagcagcagccatcgtacccctatgtgctcgacttcgccgccggctacggcgtcgtgcccacattctga

SEQ ID NO: 218 - protein, 374 aa, Sorghum bicolor
  misc_feature: Ceres Annot ID no. 8671780
  misc_feature (1)..(374): Bit score of 474.1 for hmm based on sequences of FIGURE 2.
  misc_feature (280)..(324): Pfam Name: CCT Pfam Desc: CCT motif
  misc_feature (53)..(100): Pfam Name: zf-B_box Pfam Desc: B-box zinc finger
  misc_feature: Functional Homolog Of SEQ ID NO. 20
MEALVAGRYWGVGGRRCEACGGSPAAVHCRTCPGGGAYLCAGCDAGHARAGHERVWVCEVCERAPAAVTCRADAAALCAACDADIHDANPLARRHERVPVQPIGAAAAAPAAETLLFGAAAEENQDDDDGAAAAAKVVGVDAGKLADFLFADVMDPFFGQDFTGGTRFPHADSVVPNQGSCGAVAAKPSYSSYTAASLGHSGSSSEVGLVPDAMCGRGGSVTGGVIELDFAQSKAAYLPYAATPTHSMSSLDVGAVPERGDGVMAGRVATPPAAAAAESREARLMRYREKRKNRRFEKTIRYASRKAYAESRPRIKGRFAKRADDNDADADADFDFDAGAAAATAPARSRSQQQQPSYPYVLDFAAGYGVVPTF

SEQ ID NO: 219 - protein, 367 aa, Beta vulgaris subsp. vulgaris
  misc_feature: Public GI ID no. 186911828
  misc_feature (1)..(367): Bit score of 434.9 for hmm based on sequences of FIGURE 2.
  misc_feature (13)..(60): Pfam Name: zf-B_box Pfam Desc: B-box zinc finger
  misc_feature (298)..(342): Pfam Name: CCT Pfam Desc: CCT motif
  misc_feature: Functional Homolog Of SEQ ID NO. 20
MMKEEVSGSDTNSWARVCDTCRAAPCTVYCRADSAFLCTSCDARIHAANQVASRHERVWVCEACERAPAAFLCKADAASLCATCDAEIHSANPLARRHQRVPIMPVAGCVYGPQGGRMSEDRFLTLPEGDDHTTDHEGDEDEAASWLLLNPVKNSNNQNTNGFLTGGGEVDEYLDLLEYNSGADNQLCEQYNQQQEFKVPEKNCGGDSVVPVQCREAKDHQIQYQNFLFGMECETKSGYTYNTSISQSVSVSSMDVGVVPESAMSDISMSHPRPPKGTIDLFSSPPMQVPTQLSPLDREARVMRYREKKKNRKFEKTIRYASRKAYAETRPRIKGRFAKRTDVEAEMDQMFTNSLMADSGYGIVPSY

SEQ ID NO: 220 - protein, 368 aa, Physcomitrella patens subsp. patens
  misc_feature: Public GI ID no. 168062896
  misc_feature (1)..(368): Bit score of 368.4 for hmm based on sequences of FIGURE 2.
  misc_feature (301)..(345): Pfam Name: CCT Pfam Desc: CCT motif
  misc_feature (1)..(47): Pfam Name: zf-B_box Pfam Desc: B-box zinc finger
  misc_feature: Functional Homolog Of SEQ ID NO. 20
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSMVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRYKEKRQKRKFEKTIRYASRKAYAESRPRIKGRFTKRTDSDVEQMFSSCTADSGFGVVPSSC

SEQ ID NO: 221 - protein, 342 aa, Brassica nigra
  misc_feature: Public GI ID no. 194244852
  misc_feature (1)..(342): Bit score of 286.3 for hmm based on sequences of FIGURE 2.
  misc_feature (7)..(54): Pfam Name: zf-B_box Pfam Desc: B-box zinc finger
  misc_feature (280)..(324): Pfam Name: CCT Pfam Desc: CCT motif
  misc_feature: Functional Homolog Of SEQ ID NO. 20
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYG

SEQ ID NO: 222 - DNA, 1011 bp, Sorghum bicolor
  misc_feature: Ceres Annot ID no. 8680182
  misc_feature: Encodes the peptide sequence at SEQ ID NO. 223
atggacaccgcggtggagctggagctggagcagaagccggcggtgggttactggagcgtggtgggcgcccggccctgcgacgcgtgcgccgcggagccggcgcggctgcactgccgcgaggacggcgcgttcctgtgccccggctgcgacgcccgggcgcacggcgccgggtcccgccacgcgcgcgtctggctgtgcgaggtctgcgagcacgcccccgccgccgtcacctgccgcgccgacgccgccgcgctctgcgccgcctgcgacgccgacatccactcggccaacccgctcgcgcgccgccacgagcgcctccccgtcgcgcccttcttcggcgcgctcgctgacgcgccccagcccttcccgtccccggccttcgccgccgctgccgcagcggggggccaggctcagggggaagccgcggcggcggacaacgacgacgacgacgggagcaacgaggccgaggcggcgtcgtggctgctcgccgagcccgacaacagccacgaggacagcgccgccgccaccgccgccgacacgttgttcgcggaatcggacgcgtacctcggcgtcgacctggacttcgcccggtgcatggacggcgtcaaggccatcggcgtgccggtcgcgccgcccgagctggacatcgctgccggcagctttttctaccccgaacactccatgaaccacagtttgtcgtcgtcggaggtggcggtggtgccggacgcgcaggcggccggcgtgccggcggtggtgagcagggggaaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgctgctccgcggaggccgacgacgacgcgctggagcacgacgaaggcgcgtgcttctcgcccgcggggtcggcgcacgcggcgtcggacggcgtcgtcccgtccttctgttga

SEQ ID NO: 223 - protein, 336 aa, Sorghum bicolor
  misc_feature: Ceres Annot ID no. 8680182
  misc_feature (1)..(336): Bit score of 634.7 for hmm based on sequences of FIGURE 2.
  misc_feature (258)..(302): Pfam Name: CCT Pfam Desc: CCT motif
  misc_feature (21)..(65): Pfam Name: zf-B_box Pfam Desc: B-box zinc finger
  misc_feature: Functional Homolog Of SEQ ID NO. 20
MDTAVELELEQKPAVGYWSVVGARPCDACAAEPARLHCREDGAFLCPGCDARAHGAGSRHARVWLCEVCEHAPAAVTCRADAAALCAACDADIHSANPLARRHERLPVAPFFGALADAPQPFPSPAFAAAAAAGGQAQGEAAAADNDDDDGSNEAEAASWLLAEPDNSHEDSAAATAADTLFAESDAYLGVDLDFARCMDGVKAIGVPVAPPELDIAAGSFFYPEHSMNHSLSSSEVAVVPDAQAAGVPAVVSRGKEREARLMRYREKRKNRRFDKTIRYASRKAYAETRPRIKGRFAKRCSAEADDDALEHDEGACFSPAGSAHAASDGVVPSFC

SEQ ID NO: 224 - DNA, 2463 bp, Solanum lycopersicum
  misc_feature: Ceres Annot ID no. 8457344
  misc_feature: Encodes the peptide sequence at SEQ ID NO. 225
atggctacttctgagaattgccggaacgctgccggcgccggaaaagttgatgctgagaaagcgttgtacacggagctatggcgagcatgtgcaggtccgcttgtgacagtgccatgtgaaggcgagctggtgttctatttcccacaaggtcatattgaacaggttgaagcatcaacaaaccaagcttcagaccagcagatgccagtatataatcttccttctaagatcctctgtcgtgtgattaacgtcctgctgaaggctgaacccgatacagatgaggtgtatgcacaagtgactttgttgccagaaccaaatcaagatgagaatgtggtatcaaaggaaccgatgccctctccgccaccacgattccatgtgcactctttttgtaagacattaacagcctctgataccagcactcatggaggattttctgtcttgagacggcatgctgatgaatgcctcccgcctctggatatgtctcggcagcctccaacacaggagttggtggccaaagatttgcatgcaaatgagtggcgcttcaggcacatattccggggccagcctaggaggcaccttcttcagagtggttggagtgtctttgttagttcgaaaaggcttgttgcaggggatgcattcatatttcttagaggtgagaatggggagcttcgtgttggagtccgacgtgccatgagacagcagggtaatgctccatcatcagtgatatccagtcatagcatgcatcttggtgtccttgctacagcttggcatgctattcagacgaaaacactgacgagccctgctgactttatagttccatatgatcagtatatggagtctctgaaaaacaattactccatcgggatgaggtttaaaatgaggtttgaaggtgaagaagctccagaacagaggtttactggaactatagttggcattgaaaatgctgacctcaaaaggtggcctgagtcaaaatggagatgcctgaaggttcgatgggatgaaacttctgctattcctaggccagaccgagtttcaccctggaaagtagagccagctcttagccctcctgcacttaatccacttccaataccaaggcagaaaaggccgcgatcaaatgttctgccctcgtctcctgattcttctgtacttactagggaaggttcatccaaagtagttgtagacacttcacaagccagtgggttttcaagagttttgcaaggtcaagaaatatcaaccttgagaggcaattttgtagaaaataacgagtcggactcttctgagaagccacctatatggcaaccattactggatgacgagaaggctgatgttcattctgcgtcaaggaaatgtatatcagataaacggcttcctttagggaggcctgaatcatcttttacagatcttttatcaggttttggggggcaatctagttcatctcatggattccattcacccactgggggccaaacagcacctgctagctgggttaagcgacaagctctggataaggaaactgatttcagcttactggcaaaacaatggtctctagtgtcttctggtctctcacttaatctgatggaatcaggattgaagggtgcagatactctgtatcaaatgcggggaacatctcgactcaattgttttaacgagtatccaaccttccctggtcatagacctgacaatcagcagggaaattggttaatgcccccgtccgtgctgccttatattcagatgtccgctcattctggagaaattatgcctaaacccatggcttcaccacagcccgaagccatgaaacccaaagaagggaactgcaaactatttggcattccccttgtaagtaaatgtgccaccatagatcctgtcatgttgcggaaaaattccccgattcactcaacaagtaacatgcactttggtatacatccacatcaattccctataattgaatctgatcaaaggtctgagcaatcaaagggatcaaagctaccagatgatggcttcatagttcatgatcaggaagaacaattccaaacctctcatcctggtactcgagatagagagggcaaaggccttgttcattcaacaaggagttgcaccaaggttcataaacagggtacagcccttggaaggtctgttgatcttgcaaagttcaacaactatgaagaattgatagctgaactggatcacatttttgattttaatggtgagctcaaggctcgtaacaagaactggctggttgtatatactgatgatgagggtgacatgatgcttgttggagatgatccatgggaattttgtggtatggttcggaagatttttatctacacgaaagatgaggtgcagcggatgaaccctgggactctcaattcaaaaggcgaggacaattcttctgttgcagaaggctctgatgctaaagaagtgaagaatctacagcttcacattgattccagtccggaagattcttag

SEQ ID NO: 225 - protein, 820 aa, Solanum lycopersicum
  misc_feature: Ceres Annot ID no. 8457344
  misc_feature (1)..(820): Bit score of 1560.8 for hmm based on sequences of FIGURE 5.
  misc_feature (254)..(328): Pfam Name: Auxin_resp Pfam Desc: Auxin response factor
  misc_feature (127)..(232): Pfam Name: B3 Pfam Desc: B3 DNA binding domain
  misc_feature: Is Acted Upon By Ceres SEEDLINE ID no. ME00572 at SEQ ID NO. 111
MATSENCRNAAGAGKVDAEKALYTELWRACAGPLVTVPCEGELVFYFPQGHIEQVEASTNQASDQQMPVYNLPSKILCRVINVLLKAEPDTDEVYAQVTLLPEPNQDENVVSKEPMPSPPPRFHVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNAPSSVISSHSMHLGVLATAWHAIQTKTLTSPADFIVPYDQYMESLKNNYSIGMRFKMRFEGEEAPEQRFTGTIVGIENADLKRWPESKWRCLKVRWDETSAIPRPDRVSPWKVEPALSPPALNPLPIPRQKRPRSNVLPSSPDSSVLTREGSSKVVVDTSQASGFSRVLQGQEISTLRGNFVENNESDSSEKPPIWQPLLDDEKADVHSASRKCISDKRLPLGRPESSFTDLLSGFGGQSSSSHGFHSPTGGQTAPASWVKRQALDKETDFSLLAKQWSLVSSGLSLNLMESGLKGADTLYQMRGTSRLNCFNEYPTFPGHRPDNQQGNWLMPPSVLPYIQMSAHSGEIMPKPMASPQPEAMKPKEGNCKLFGIPLVSKCATIDPVMLRKNSPIHSTSNMHFGIHPHQFPIIESDQRSEQSKGSKLPDDGFIVHDQEEQFQTSHPGTRDREGKGLVHSTRSCTKVHKQGTALGRSVDLAKFNNYEELIAELDHIFDFNGELKARNKNWLVVYTDDEGDMMLVGDDPWEFCGMVRKIFIYTKDEVQRMNPGTLNSKGEDNSSVAEGSDAKEVKNLQLHIDSSPEDS

SEQ ID NO: 226 - protein, 563 aa, Vitis vinifera
  misc_feature: Public GI ID no. 157327120
  misc_feature (1)..(563): Bit score of 794.2 for hmm based on sequences of FIGURE 5.
  misc_feature (202)..(281): Pfam Name: Auxin_resp Pfam Desc: Auxin response factor
  misc_feature (75)..(180): Pfam Name: B3 Pfam Desc: B3 DNA binding domain
  misc_feature: Is Acted Upon By Ceres SEEDLINE ID no. ME00572 at SEQ ID NO. 111
MEQLQASTNQGVDQRIPLFNLPSKILCRVVHTRLLAEQETDEVYAQITLQPEADQTEPKSPDSCPDEAPKQTVHSFCKILTASDTSTHGGFSVLRKHANECLPPLDMSQATPTQELVARDLHGYEWRFKHIFRGQPRRHLLTTGWSTFVTSKRLVAGDAFVFLRGDNGELRVGVRRLARQQSPMPSSVISSQSMHLGVLATASHAVTTQTLFVVYYKPRTSQFIISLNKYLEAVNYGFAVGMRFKMRFEGEDSPERRFTGTIVGIGDISPQWSNSKWRSLKIQWDEPATIQRPERVSSWDIEPFVASASLNLTQPPVKIKRPRPLDLPVAVPSPFWYAGSSPSHELTQLDSKTVSTRSILSGYNTSLSSRPNNGLISDQVEKGKRIEASIGCRLFGIDLTNNSKATALLEMIQNLDVSKSSNEQKQVVPEASQKETQGRQSCTPSSRTRTKKVQMQGVAVGRAVDLTALEGYDELISELEKMFEIKGELCPRNKWEVVFTDDEGDMMLVGDDPWQEFCKMVRKIFIYSSEEVKKMSPRCKLSTSSLDGEGTVISLDSELRTEP

SEQ ID NO: 227 - protein, 737 aa, Vitis vinifera
  misc_feature: Public GI ID no. 157358702
  misc_feature (1)..(737): Bit score of 957.5 for hmm based on sequences of FIGURE 5.
  misc_feature (278)..(360): Pfam Name: Auxin_resp Pfam Desc: Auxin response factor
  misc_feature (151)..(256): Pfam Name: B3 Pfam Desc: B3 DNA binding domain
  misc_feature: Is Acted Upon By Ceres SEEDLINE ID no. ME00572 at SEQ ID NO. 111
MIDLNTVDDDETPSSGSSSSSSSSASASASTVCGSLLSAASSVCLELWHACAGPLISLPKKGSLVVYFPQGHLEQLSDYPAVAYDLPPHVFCRVVDVKLHAEVVTDEVYAQVSLVPETKQIKQKLQEGEIEADGGEEEDIEGSIKSMTPHMFCKTLTASDTSTHGGFSVPRRAAEDCFPPLDYKQQRPSQELVAKDLHGFEWRFRHIYRGQPRRHLLTTGWSAFVNKKKLVSGDAVLFLRGGDGELRLGIRRAAQIKGSSPFPALCSQQLNLNTLTAVVNAISTRSVFNICYNPRASSSEFIIPLRKFSKSIDHSFSAGMRFKMRVETEDAAERRYTGLITGISDMDPVRWPGSKWRCLLVRWDDIEANRHNRVSPWEIELSGSLSGSGSLTVPGSKRTRIGLPGTRPDFSVPNGMGVSDFGESSRFQKVLQGQEIFGFNTPYDGVDTQDHHPSEIRCFPGSSCSGIAAIGNGVRNPLGNSDISYKGIGFGESFRFHKVLQGQETFPSPPCGRALSANQAHENGSFGIFDGVQVPTSRNGWPALVQGYNAHTHLSTPSVQVSSPSSVLMFQQASTAAPNIYSMHSANNQEKEQEISNRSSFDIPEVYGEKLTPSRCELSVRGGGQGGMNFFGLLNEHNQLAVPHPLVTQSAFRGSQDLVPTCKSSCRLFGFSLTEERSIGNKVDNPTPVTSSLIPGTSFLPQQLHSEPPVMTKAIGSNCTKVSDFYAVRDMLFDIAL

SEQ ID NO: 228 - DNA, 2922 bp, Panicum virgatum
  misc_feature: Ceres Clone ID no. 1892720
  misc_feature: Encodes the peptide sequence at SEQ ID NO. 229
aaaaaaaaaacccaacgcctcggctccaagccagccagccaaccaacccgccccgggcagcaaagcacaggcgcacgagctcccacagctccccagctccacgcctcctccctcgcgctcccgccatcctctcctccgccgcgcgccttcccgcccgccgagcctttggggtggttccggagtcgcggccgcgcgcgcgagagcgagaccctcccctgctgccgagcgtaaatctgccgagctcggcatggggtgaccagatcggggcgcggctcggtgctctacggctgaattccgctcgaggaggggggtttgccttgcctagaagaggccgcggggatggcgaacgccggcgtggccgtcggctcagggggtgttagccatgctttgttcagggaactctggcatgcttgtgctgggctgttggtcacggtgcctcgccaaggcgagctggtttactacttcccgcaaggtcatatggaacagcttgaagcatctacagatcagcaacttgaccagcacttacctttgtttaatctaccatccaagatcctgtgcaaggtggtaaatgtagaactcagagctgaaactgattccgatgaagtttatgctcaaattatgctgcaaccagaagcagatcaaagtgagcccaccagcccagctcctgagctaccagagccagaaaggtgcaatgtccattccttctgcaagactttgactgcttcagacacgagcacccatggtggtttctctgtcctcaggagacatgctgaagaatgtttgccccaattggatatgactcagaacccaccgtggcaagaactggtggctaaagatctccatggaaatgaatggcatttccgtcacatctttcgaggtcaaccaaggaggcatctacttacaacaggttggagtgtttttgttagctcaaaaagattggttgccggtgatgcatttatctttttgagaggtgagaatggagagctacgagtcggggtaagaaggctcatgaggcaagtaaataacatgccatcatcagttatctcaagccacagcatgcatcttggagtcctcgcaactgcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtgatgaatctcctgaaagaagatttagtggaacaattattggtctgggaagcatgccagctaactcaacatctccgtgggctgactctgattggagatctttgaaggtccaatgggatgagccttctgctgttgtccgtccagatagagtttcaccatgggaactagaaccccttgatgcaactaacacacaaccgcctcagcctcctttacggagtaagcgtgcacggcctcctgcttcaccttctattgctccagaacttcctccagcttttggtttttggaaatccccacctgagcctacccatgctttctcattttcgggactgcagcgaacccaggaactataccattcaaatcccaattcgatcttttcatcatcgttgaatgtgggatttaattcaaagaacgagcattctactccaaccaacaatcatttgtattggccaattcgagacactagaacggaatcctactctgctagcattaacaaacttccacctgaaaggaagcaagaattcactattgctggctgcagattgtttggtattgagttaagtaatgcagtatcaccagtggttgctgttgctagtgctggtcaagaccaaccacctgttgtgtcagtagatgttgagcctgatcagctgtcacagccatcccaagccaacaaaacggatgccccagcagcaagcagtgagcgctctcctcatgagactgagagccggcaagtcaggagctgcaccaaggtaatcatgcaaggaatggcggttggcagggcagtggacttgacgaggctagaagggtatgatgatcttctccacaagttggaggagatgtttgatatccagggggagctttctgctagcctcaagaaatggaaggttatttacacggatgatgaggatgatatgatgctggttggggatgatccgtggcctgaattttgcggcatggtgaaaaggatatacatttactcctatgaggaggccaagtctttgactcccaaggtgaagctgccggtcattggtgacaccactaaactgaacctagacaaattgtcaccagaatctgacatgccgcagagtgactcaaacaacatcgctctggttgccgccgataaggactgatggatgctaacttggtgctttaccttttcttccctttttggatgtttgggaggcaatgcccatgctccttgagactgctaagagttatctgtttgttgcgctgtgggcctcaaggacgttgccccacaatctgcctgactgccttggtttgcaatggctgatgtaggaccagtggtggtcctctgccagcaaggacgactggaacgtaatggcaagcaggctgcgtgcgcgccgttccctgtggcaccaacctgtgttttgtttgccgtgtttggtaggaggcatggcgaattgccggctgcttggttttggagactgccactgactgctgccgtctcgttggtcgacgtcggccggcaggccgcgcccctcacctccagtaaataggacttcatgtacaactagtttggtagtagcagtagtggtttatgtatatcagcgtcatgttccttgctacctatataagcatcatcatctgtagctgctgctcccaccttgcattgtattctacccccggcttggtaccgaatgatctggtgcaaaaaagtctcagcttgctgttcc

SEQ ID NO: 229 - protein, 672 aa, Panicum virgatum
  misc_feature: Ceres Clone ID no. 1892720
  misc_feature (1)..(672): Bit score of 1319.2 for hmm based on sequences of FIGURE 5.
  misc_feature (248)..(333): Pfam Name: Auxin_resp Pfam Desc: Auxin response factor
  misc_feature (121)..(226): Pfam Name: B3 Pfam Desc: B3 DNA binding domain
  misc_feature: Is Acted Upon By Ceres SEEDLINE ID no. ME00572 at SEQ ID NO. 111
MANAGVAVGSGGVSHALFRELWHACAGLLVTVPRQGELVYYFPQGHMEQLEASTDQQLDQHLPLFNLPSKILCKVVNVELRAETDSDEVYAQIMLQPEADQSEPTSPAPELPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQVNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWADSDWRSLKVQWDEPSAVVRPDRVSPWELEPLDATNTQPPQPPLRSKRARPPASPSIAPELPPAFGFWKSPPEPTHAFSFSGLQRTQELYHSNPNSIFSSSLNVGFNSKNEHSTPTNNHLYWPIRDTRTESYSASINKLPPERKQEFTIAGCRLFGIELSNAVSPVVAVASAGQDQPPVVSVDVEPDQLSQPSQANKTDAPAASSERSPHETESRQVRSCTKVIMQGMAVGRAVDLTRLEGYDDLLHKLEEMFDIQGELSASLKKWKVIYTDDEDDMMLVGDDPWPEFCGMVKRIYIYSYEEAKSLTPKVKLPVIGDTTKLNLDKLSPESDMPQSDSNNIALVAADKD

SEQ ID NO: 230 - DNA, 2076 bp, Sorghum bicolor
  misc_feature: Ceres Annot ID no. 8667998
  misc_feature: Encodes the peptide sequence at SEQ ID NO. 231
atggcgggcattgacctcaacaccgtggaggaggaggacgaggaggaggcggaggcggaggcgccgcctgtggccgccagggccggtggtggcgccgtgtgtctggagctgtggcacgcgtgcgcgggccccgtcgcgccgctgccgcgcaagggcagcgccgtcgtgtacctgccgcagggccacctcgagcacatcggcggcgacgctgacgcggcgggagcagcggtgccgccacacgtgctctgccgcgtcgtcgacgtcaccctccacgcggacggcgccaccgacgaggtgtacgcgcgggtgtcgctgctgcccgaggacgaggaggcggagaggcgggcgcgggcgcgggttcgggaggacgaggacgcggatcgcgacggcgaggacggggccgccatgaagccgctcgcacggacgccgcacatgttctgcaagacgctcacggcctctgacaccagcacgcacggcggcttctccgtgccgcgccgcgccgccgaggactgcttcccgccgctggactacagccagcagaggccgtctcaggagctcgtggccaaggatctacacggcacggagtggaagttccgacatatctaccgaggccagccacgaaggcatctcttaaccactggatggagtgcatttgttaataagaagaagcttgtttctggcgatgcagttctgttccttcgaggtgaagatggagtgcttcgactgggagtgcgccgagcagcccagctaaaaattgtaactcctattcctgcactgcataaccagtgctcaagccagaccactctgggaaatgttgcacaagctgtggccacgaggactgttttccacatttactacaatcccaggttaagtcaatctgaattcattgtaccctattggaagttcaccagaagcttgaatcaaccaatttctgttggaatgagatgcagaatgcgatatgaaagtgacgatgcttctgaaagaaggtgcactgggataataattggaagcagagaagctgagcctatttggtatggttcaaaatggaaatgcttggtggttagatgggatgatggtatagagtgccattggcccaatagggtatctccttgggagattgaggtcacaggatcagtttcaggatctcatatgtgcgctcccaattcaaaacgtctgaaaccatgcctccctcaagttaatccggagattgtgcttccaaatggaagcgtttcttcagattttgcgggatctgtcagattccacaaggtcttgcaaggtcaagaattgttgggtttgaaaacccatgacggtactgctatttctgcttttcaggcaactgaagcaagtaatttgcagtacagtgatgaacgtagtaacatgagtaacaatatcttagggatcccaaggctcggtgttagatctccaaatggaatccctggatttccctaccattgctcaggctttggggaatctcaaagattccaaaaggtcttgcaaggtcaagaagtgtttcgtcctttccgaggaggatgtttggctgatggccatataagaactgctggcatgtatcaacctaaatggcctgcaccacaagggtgtgattttccacagccagcaaaaccggtacttgtgttgcaagcatcctccccatcatctgtgctgatgtttccacaaactggttctaagataactccattggaatatgagtacagctgcctggataaggatgaggatggtagatttgataggactgtccctactcaagatatgggaagaaacaatcaaacattatctctttggcctcatcttgtttccggcgaagcaatagaagaatgtactggaactgagaatatgcactcttctgtcagtggtgcagagcatgaatcaaacaatgagagtacagttgaaaatggctgcaaaatctttggtatctcattggctgaaaagatccgatcatgtgatgaagcagactcttgtagtgcaaaacgtaattctgggctccagccttcgaggtcacaaatactaggcagctgttgggccacttttgcctgtaattttcaagaccgaatcttttga

SEQ ID NO: 231 - protein, 691 aa, Sorghum bicolor
  misc_feature: Ceres Annot ID no. 8667998
  misc_feature (1)..(691): Bit score of 955.7 for hmm based on sequences of FIGURE 5.
  misc_feature (272)..(353): Pfam Name: Auxin_resp Pfam Desc: Auxin response factor
  misc_feature (145)..(250): Pfam Name: B3 Pfam Desc: B3 DNA binding domain
  misc_feature: Is Acted Upon By Ceres SEEDLINE ID no. ME00572 at SEQ ID NO. 111
MAGIDLNTVEEEDEEEAEAEAPPVAARAGGGAVCLELWHACAGPVAPLPRKGSAVVYLPQGHLEHIGGDADAAGAAVPPHVLCRVVDVTLHADGATDEVYARVSLLPEDEEAERRARARVREDEDADRDGEDGAAMKPLARTPHMFCKTLTASDTSTHGGFSVPRRAAEDCFPPLDYSQQRPSQELVAKDLHGTEWKFRHIYRGQPRRHLLTTGWSAFVNKKKLVSGDAVLFLRGEDGVLRLGVRRAAQLKIVTPIPALHNQCSSQTTLGNVAQAVATRTVFHIYYNPRLSQSEFIVPYWKFTRSLNQPISVGMRCRMRYESDDASERRCTGIIIGSREAEPIWYGSKWKCLVVRWDDGIECHWPNRVSPWEIEVTGSVSGSHMCAPNSKRLKPCLPQVNPEIVLPNGSVSSDFAGSVRFHKVLQGQELLGLKTHDGTAISAFQATEASNLQYSDERSNMSNNILGIPRLGVRSPNGIPGFPYHCSGFGESQRFQKVLQGQEVFRPFRGGCLADGHIRTAGMYQPKWPAPQGCDFPQPAKPVLVLQASSPSSVLMFPQTGSKITPLEYEYSCLDKDEDGRFDRTVPTQDMGRNNQTLSLWPHLVSGEAIEECTGTENMHSSVSGAEHESNNESTVENGCKIFGISLAEKIRSCDEADSCSAKRNSGLQPSRSQILGSCWATFACNFQDRIF

SEQ ID NO: 232 - DNA, 2439 bp, Sorghum bicolor
  misc_feature: Ceres Annot ID no. 8721170
  misc_feature: Encodes the peptide sequence at SEQ ID NO. 233
atggcggcggctgcaccggcggccggcggcggcggtggtgcggaagcgggatgcggaggaggcggagggaaggacccgctgttcgtcgagctgtggaaggcctgcgcggggccgctgtctagcgtgccgccgctcggggagaaggtctactacttcccgcagggccacatcgagcaggtggaggcatcgacgaaccagattgctgagcagcagggcacgcccctctacaacctgccatggaagattccatgcaagctcatgaacatcgagctgaaggctgagccggatactgatgaggtgtacgcccagctcaccctgctccctgataagaagcaagatgagaatacatctacaacagtggagaatgaggaggcagaggaggaggtggtgcctcatgcgccaccaacaaatgagggacctcggatccattccttttgcaagacattgactgcctcagacacaagcacgcatggtggtttctcagtgttgcgccggcatgcagatgagtgcctcccaccattggatatgagtcaacaccccccaaatcaagaattggtggccaaggacctgcatgggattgagtggcggttccgtcacatctttcgaggtcagccacggagacacctccttcagagtggttggagtgtttttgttagcgccaagcgtcttgttgcaggggatgccttcatatttctcagaggtgagaatggggagttacgtgttggggttcggcgtgcactgaggcaccaaaccactatcccatcttcagtcatatcaagccacagtatgcatcttggtgttcttgcgacagcatggcatgcagtcaacactgggagtatgttcactgtctactacaagccaaggactagtccagctgaatttgtggtctcgcgagataggtactatgaatcactgaaacgaaattattcaatagggatgagatttaagatgagatttgaaggtgaagaagcagcagagcaaagattcactggcacaatagttggaataggtgcttctgatccatctggttgggctgactcaaaatggcgttcccttaaggtgagatgggatgaagcttcttctgttcctcgtcctgaaagagtttctccttggcaaatagaacctgctattagcccatctcctgtgaaccctcttccagtcagattcaagaggtctcgttcaagtgttaatgcttcaccatctgacgtgcctactgtatccagagaaggtcgataccatgatagcagtgatgtgaagactgctcaggatcttaccatgtggtcttcaggaactgagcagcagagaaacaatattgctgcccagacaaagcgaagtctggagggatggacgcaatctagaactcctgaaggttacaatcagctgttctcggcatttcaaccactgaaagatacacataatccactttgtactttccctagtcaaatatctgggactcgctcaaatacctgggacacagccgatgctcgttatccagcccaacaagccaatcacaacatgttacatggcacatggccttttatgcctcatagcagtggttttaggacgaatcaacagaattatctagtgatgcctgaagctgcaaagtttactgggaaatcagctttcacttcacttcagggccatggcactgatcagtgctccacaggctggtttggacatattgagtcaagttcccgcacagaccatgcatcgtcaagttcgatcaggccccagcctttggttattggtaatgatgttcagaaaaccaaaggcacttcattcaaactatttgggattcctcttggcagcccggaaaaatctgaacctctggtatccccaccaagtgtcgcatatgacgggaaacttcaaacttctccatcagaaaaagggaatcagctagacatagttggagtggataattgttctgatccttcgaagactgtgaagccatttgatggtcctcaatcagattcgattacagagaataatcagccttgtccagaagctacccagaatattcagaacaaagtgcaaagtagttccaccagaagctgcaagaaggtccataagcaaggcagtgccctcggcagatcgattgatctaacaaagttcacttgctacgatgagctgattgctgaactggatcagatgtttgactttgatggtgagctgaagaatccatgcaaaaattggctggttgtctacactgacaatgaaggcgatataatgctggttggcgatgacccctggaatgaattctgcgacatggtccacaagatcttcatctacacaagggaggaagtggaaaggatgaacccaggtgccctaaactcaaggtccgaggatagtctgtctgactcgcagggaagagggttggcttccaaagagccgccccgaggtggcccgtctacttcgactcccaattccgagagctgctaa

SEQ ID NO: 233 - protein, 812 aa, Sorghum bicolor
  misc_feature: Ceres Annot ID no. 8721170
  misc_feature (1)..(812): Bit score of 1310.2 for hmm based on sequences of FIGURE 5.
  misc_feature (271)..(353): Pfam Name: Auxin_resp Pfam Desc: Auxin response factor
  misc_feature (144)..(249): Pfam Name: B3 Pfam Desc: B3 DNA binding domain
  misc_feature: Is Acted Upon By Ceres SEEDLINE ID no. ME00572 at SEQ ID NO. 111
MAAAAPAAGGGGGAEAGCGGGGGKDPLFVELWKACAGPLSSVPPLGEKVYYFPQGHIEQVEASTNQIAEQQGTPLYNLPWKIPCKLMNIELKAEPDTDEVYAQLTLLPDKKQDENTSTTVENEEAEEEVVPHAPPTNEGPRIHSFCKTLTASDTSTHGGFSVLRRHADECLPPLDMSQHPPNQELVAKDLHGIEWRFRHIFRGQPRRHLLQSGWSVFVSAKRLVAGDAFIFLRGENGELRVGVRRALRHQTTIPSSVISSHSMHLGVLATAWHAVNTGSMFTVYYKPRTSPAEFVVSRDRYYESLKRNYSIGMRFKMRFEGEEAAEQRFTGTIVGIGASDPSGWADSKWRSLKVRWDEASSVPRPERVSPWQIEPAISPSPVNPLPVRFKRSRSSVNASPSDVPTVSREGRYHDSSDVKTAQDLTMWSSGTEQQRNNIAAQTKRSLEGWTQSRTPEGYNQLFSAFQPLKDTHNPLCTFPSQISGTRSNTWDTADARYPAQQANHNMLHGTWPFMPHSSGFRTNQQNYLVMPEAAKFTGKSAFTSLQGHGTDQCSTGWFGHIESSSRTDHASSSSIRPQPLVIGNDVQKTKGTSFKLFGIPLGSPEKSEPLVSPPSVAYDGKLQTSPSEKGNQLDIVGVDNCSDPSKTVKPFDGPQSDSITENNQPCPEATQNIQNKVQSSSTRSCKKVHKQGSALGRSIDLTKFTCYDELIAELDQMFDFDGELKNPCKNWLVVYTDNEGDIMLVGDDPWNEFCDMVHKIFIYTREEVERMNPGALNSRSEDSLSDSQGRGLASKEPPRGGPSTSTPNSESC

SEQ ID NO: 234 - DNA, 2007 bp, Sorghum bicolor
  misc_feature: Ceres Annot ID no. 8679636
  misc_feature: Encodes the peptide sequence at SEQ ID NO. 235
atggcggacgccggcgtggcgcgcggcccagggagtgctggcgatgctctgttcagggaactctggcatgcttgtgctgggccgttggtcacagtgcctcgccaaggcgagctggtttactacttcccgcagggtcatatggaacagcttgaagcatctacagatcaacaacttgatcagcacttacctctgtttaatctaccacccaagatcctctgcaaggtggtcaatgtagaacttagagctgaaactgattccgatgaagtttatgctcagattatgctacaacccgaagcagagcaaaatgagcccaccagcccagatgctgagccacccgagcctgaaagatgcaacgtccattccttctgcaagaccttgactgcttcagatacaagtacccatggtggattctctgtcctcaggaggcatgctgaagaatgtctgccccaactggacatgactcagaatccaccatggcaagaactggtggctaaagatctccatggaaatgaatggcatttccgtcacatctttcgagggcaaccaaggaggcatctacttacgacaggctggagtgtttttgttagctcgaaaagattggttgctggtgacgcgtttatctttttgagaggtgagaatggagagctgcgagtcggggtgaggaggctcatgaggcaactaaacaacatgccatcttcggttatctcaagccacagcatgcatcttggagtccttgcaactgcatctcatgccatctccactggaactctcttttctgttttctacaaacccagaacaagtcgatcagaatttgtcgttagtgtaaacaagtaccttgaagctaagaatcacaagatgtctgttggtatgaggtttaaaatgagatttgagggtgacgaatctcctgaaagaagattcagtgggacaattattggtctgggaagcatgccagctaactcaacatctccgtgggctaactctgagtggagatctttgaaggtccaatgggacgagccttctgctattctgcgtccagatagagtttcaccatgggaactagaaccccttgatgcaactaatccacaaccacctcaacctcctttacggaataagcgtgcgcggcctcctgcttcaccttccattgctccagaacttcctccagtttttggtttttggaaatccccagctgagcctgcccaagctttctcattttcaggactgcagcgaactcaggaattataccattcaaaccccaattcaatcttctcgtcatcgttgaatgtaggattcaattcaaagaatgagcgttctactccaaacaacaatcatttgtactggacaatgagagagacaagaactgaatcctactctgctagcattaacaaagctcctactgaaaagaagcaagaatctgctacttctggctgcagattgtttggtattgagataggttctgcagtatcaccagtggttactgttgctagtgttggtcaggatccaccacctgctctctcagtagatgttgaatctgatcagctgtcacaaccatcccatgccaacaaaacggatgccccagcggcaagcagtgagcgctctcctaatgaaacagagagccgacaagtcaggagctgcaccaaggtaatcatgcaaggaatggcggttggcagggcagtggacttgacgaggttagatgggtatgatgatcttcaccgcaagttggaggagatgtttgatatccatggagagctttctgccaacctcaggaaatggaaggttgtttacacagatgatgaggatgacatgatgctggtcggggacgatccatggaagatggtaaaaaggatatatatttactcttacgaggaggccaaatctttgactcccaaagcgaagctgccagtcattggtgacaccatcaagccagacccaaacaaattgtcaccggaatctgacatgccacagagtgacacaaacagcaatgctcccgttgctgctgataaggattga

SEQ ID NO: 235 - protein, 668 aa, Sorghum bicolor
  misc_feature: Ceres Annot ID no. 8679636
  misc_feature (1)..(668): Bit score of 1385.0 for hmm based on sequences of FIGURE 5.
  misc_feature (248)..(333): Pfam Name: Auxin_resp Pfam Desc: Auxin response factor
  misc_feature (121)..(226): Pfam Name: B3 Pfam Desc: B3 DNA binding domain
  misc_feature: Is Acted Upon By Ceres SEEDLINE ID no. ME00572 at SEQ ID NO. 111
MADAGVARGPGSAGDALFRELWHACAGPLVTVPRQGELVYYFPQGHMEQLEASTDQQLDQHLPLFNLPPKILCKVVNVELRAETDSDEVYAQIMLQPEAEQNEPTSPDAEPPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGENGELRVGVRRLMRQLNNMPSSVISSHSMHLGVLATASHAISTGTLFSVFYKPRTSRSEFVVSVNKYLEAKNHKMSVGMRFKMRFEGDESPERRFSGTIIGLGSMPANSTSPWANSEWRSLKVQWDEPSAILRPDRVSPWELEPLDATNPQPPQPPLRNKRARPPASPSIAPELPPVFGFWKSPAEPAQAFSFSGLQRTQELYHSNPNSIFSSSLNVGFNSKNERSTPNNNHLYWTMRETRTESYSASINKAPTEKKQESATSGCRLFGIEIGSAVSPVVTVASVGQDPPPALSVDVESDQLSQPSHANKTDAPAASSERSPNETESRQVRSCTKVIMQGMAVGRAVDLTRLDGYDDLHRKLEEMFDIHGELSANLRKWKVVYTDDEDDMMLVGDDPWKMVKRIYIYSYEEAKSLTPKAKLPVIGDTIKPDPNKLSPESDMPQSDTNSNAPVAADKD

SEQ ID NO: 236 - DNA, 2415 bp, Sorghum bicolor
  misc_feature: Ceres Annot ID no. 8670373
  misc_feature: Encodes the peptide sequence at SEQ ID NO. 237
atggcgctgccgtcccaggccccgtctaactcaggggatccgctgtacccggagctctggcgcgcctgcgccggcccgctcgtcaccgtccctcgcgtcggcgacctcgtcttctactttccccagggacacatcgagcaggtggaggcgtccatgaaccaggtcgccgggaaccagatgcgcctctacgatctgccctccaagctgctctgccgcgtgctcaacgtcgagcttaaggcggagacggacaccgacgaggtctacgcgcagatcatgctcatgccagagcccgagcaaaccgatgtggcggctgagaaggcgagttctgcgtccgctgcgtcgccgaggccagcagtgaggtccttctgcaagacgctcaccgcctccgacaccagcacacacggaggcttctctgtgctgcgccgccacgcagacgagtgcctcccaccactggatatgacgcagtcgcctcccacacaggagctggtggcgaaggatctgcatggcatggagtggcgcttccgccacatctttcgcgggcaacccaggaggcatctccttcagagtggttggagtgtttttgttagttccaaaaggcttgttgctggagacgccttcattttcctcagaggagaaaatggtgaacttcgggttggtgttaggcgggctatgaggcagttgtctaatgtaccttcttcagtcatatctagccaaagcatgcacctcggagtccttgcgactgcatggcacgccatcaacaccaaatccatgttcactgtctactacaagcctaggacgagcccttcagagttcatcataccatatgatcaatatatggagtcagtgaaaaataactattcaattgggatgagattcagaatgaggtttgaaggggaagaggcaccagagcagaggtttactggtacaatcgttggctgtgaaaatcttgacccactatggcctgattccagttggagatacttgaaggtgcgctgggatgagccttctactatcccacgaccagatagggtctctccttggaagatagagcctgcttcatcacctccagttaatccactcccgctttcttctagagtaaaaagacctagacaaaatgctcctccaccttcacctgaagcatctgttctcacaaaagaaagtgcagccaagatcgatattgactctgctcaaacacaacatcaaaattcggtcttgcaaggtcaagagcaaatgaccttgaggaacaacctgactgaaagcaacgactctgattccactgttcaaaagccgatgatgtggtccccatcacccaatgggaaagcccacactaactttcagcagagacctgctatggatagttggatgccaatgggaaggcgtgaaacggacttcaaggactcacgttccgccttcaaggatgcccgcactgcctctcaatcatttagagatacacaggggttcttcatgcaagcttatgatgacaatcatcaccgtctttctttcaacaaccagtttcaggatcagggttcagctcatcgctttgcggatccatacttctatatggcccaacaaccttctctgactgttgaatcaagcacaaggacacaaacagcaaacaacgacttgcgtttctggggcgaccagaattcgatctatggtaatccaggtgatcaacagcagcagggtttcagctttggacaaaacccatcaagttggttgaaccagccatttccccaggttgaacagccacgagtggttaggcctcatgcaacagttgctccatttgatttggaaaagaccagagaaggcagcgggttcaagatctttgggttccaagttgatacaaccagtccatctcctgcccagttgagctctccattatgtgctatccgggagcatgtggtacaaacccgaccatcggcaccagtgaatgaattgcaacctgtgcaaaatgagtgcttgcctgagggatctgtaagcactgctggaactgcaactgagaacgagaaaaacattcagcaagcccagccaagttcaaaagatattcaaagcaagtcccagggtgcttcgacaaggagctgcacaaaggttcataagcaaggggttgcgcttggcagatctgtggacctctcaaaattcactgactacgatgaactcaaagcagaattagacaagatgtttgaattcaatggcgaattagtatctgccaacagaagctggcagatcgtttatactgacaatgagggtgacatgatgcttgtgggggatgacccgtgggaagagttctgtagcatagtgcgcaagatctacatctatacgaaggaggaggtccagaagatgaactcaaaatcatctgcgccaaggaaggaggagcctctaacagtgggtgaaggatgcgccgccacaaatgagtag

SEQ ID NO: 237 - protein, 804 aa, Sorghum bicolor
  misc_feature: Ceres Annot ID no. 8670373
  misc_feature (1)..(804): Bit score of 1526.4 for hmm based on sequences of FIGURE 5.
  misc_feature (248)..(329): Pfam Name: Auxin_resp Pfam Desc: Auxin response factor
  misc_feature (121)..(226): Pfam Name: B3 Pfam Desc: B3 DNA binding domain
  misc_feature: Is Acted Upon By Ceres SEEDLINE ID no. ME00572 at SEQ ID NO. 111
MALPSQAPSNSGDPLYPELWRACAGPLVTVPRVGDLVFYFPQGHIEQVEASMNQVAGNQMRLYDLPSKLLCRVLNVELKAETDTDEVYAQIMLMPEPEQTDVAAEKASSASAASPRPAVRSFCKTLTASDTSTHGGFSVLRRHADECLPPLDMTQSPPTQELVAKDLHGMEWRFRHIFRGQPRRHLLQSGWSVFVSSKRLVAGDAFIFLRGENGELRVGVRRAMRQLSNVPSSVISSQSMHLGVLATAWHAINTKSMFTVYYKPRTSPSEFIIPYDQYMESVKNNYSIGMRFRMRFEGEEAPEQRFTGTIVGCENLDPLWPDSSWRYLKVRWDEPSTIPRPDRVSPWKIEPASSPPVNPLPLSSRVKRPRQNAPPPSPEASVLTKESAAKIDIDSAQTQHQNSVLQGQEQMTLRNNLTESNDSDSTVQKPMMWSPSPNGKAHTNFQQRPAMDSWMPMGRRETDFKDSRSAFKDARTASQSFRDTQGFFMQAYDDNHHRLSFNNQFQDQGSAHRFADPYFYMAQQPSLTVESSTRTQTANNDLRFWGDQNSIYGNPGDQQQQGFSFGQNPSSWLNQPFPQVEQPRVVRPHATVAPFDLEKTREGSGFKIFGFQVDTTSPSPAQLSSPLCAIREHVVQTRPSAPVNELQPVQNECLPEGSVSTAGTATENEKNIQQAQPSSKDIQSKSQGASTRSCTKVHKQGVALGRSVDLSKFTDYDELKAELDKMFEFNGELVSANRSWQIVYTDNEGDMMLVGDDPWEEFCSIVRKIYIYTKEEVQKMNSKSSAPRKEEPLTVGEGCAATNE

SEQ ID NO: 238 - DNA, 2565 bp, Sorghum bicolor
  misc_feature: Ceres Annot ID no. 8690553
  misc_feature: Encodes the peptide sequence at SEQ ID NO. 239
atgacttcggcggcggccgcggcccaggcggcgggagggggtggaggaggaggaggagtctgcgagggggatgccgctgccgcggcgcgaggcggaggcggaggcggaacggaggacggcatgtacacggagctctggagcctctgcgccggcccgctggtcacggtgcccagggtcggggacaaggtctactacttcccacagggccatatcgagcaggtggaggcatcgaccaaccaggtggctgagcagcacatgcaactttacaatctcccatggaagatcctgtgtgaggtcatgaatgttgaattgaaggctgagccggacaatgatgaggtttatgcccagctcactctgctacctgaatcgaagccagaggagaatggctctagtcaggaggagatgcctgctgcacctcctgctgcacttgcaaggccacgtgtgcactccttctgcaagacattgacagcctctgacaccagcacacatggtggtttctcggtgctgcgtcgccatgcagatgaatgccttccaccgctggatatgagtcgtcaacctccaacacaagagcttgtggccaaggatctgcatggtgtggaatggcgctttcgtcacatattcagaggtcaacccggaaggctttttttgcagagtggctggagtgtttttgttagtgcaaagcgtcttgttgctggggatgccttcatctttctgagaggtgataatggggagctgcgtgtgggagtcaggcgtgccatgaggcagcaagcaaatgttccgtcttcagtaatatcaagccacagcatgcatcttggtgttcttgctactgcatggcatgctgttaacactgggaccatgttcactgtctactacaaacctaggacaagtccagctgagtttgttgtcccctgtgatcgctatacggagtcactgaaacgaaattaccctatagggatgagatttaaaatgaggtttgaaggtgaagaggctccagagcaaaggttcactgggacgattgttggaaatgtggatcctgaacaagctggatgggctgaatctaaatggcgttacctcaaggtgaggtgggatgaagcttcctccattccacgtcctgaaagggtttctccttggcaaatagaacctgcagtcagccctccccctgtcaatccacttccagtacacaggcccaagaggcctcgctctaatgctgtagcttctctggctgagtcttcagctccaacaaaagaagctgctccgaaggtcacattagagactcaacaacatgccctgcaaaggcccttgcagacccaggataatgcggccccaaaaagtggttttggtgataacagtgagttggacgctgctcataagtcagccctgcgaccatcagggtttgatctagagaagaacaccattggcatgcagaggaagctgggttcagatagttggatgcatatgaacagacctgaaggatacaatgaaatgttatctggatatcaacaacctaataaagatgtacagaatccacagggtttctgttctttacctgatcagattgctgccggtcgtcctaatttctggcacaccgtaaatgctcattatcaagaccagcaaggcaatcacaatctattccctggttcatggtccatgatgccttcaagtactggctttgggttgaacagacagagctatccaatgatgcaggaagttggtgggttgtctcagagtgctacgaacaccaagtttgggaatggagcttatgctgcactacctggtcatggcattgatcaatactcttctggatggtttgggcacatgatacctggtgctcgcatggacgatgtccagccacgcgtgattaagcctcaacctttggtccttgctcatggtgaagctcagaaaatgaaaggcaattcatgcaagctttttggaattcaccttgatagcccagccaaatctgaacctttgaaatctccaccaagtgttgcctatgatgggatgccacaaactccagcagcagctgaatggcggatggttgattcaattgaagcagacagatgttctgatccacttaagatgccaaagcaactcgatgctacacaggtagatcctgttccagagaaatgttcacaagtttcaagaggcacacagtgcaaatcacaaggtggatcaactaggagctgcaagaaggtccacaagcaaggaatcgcacttggcaggtctgtggatcttacaaagttcaatggctacacggaattgattgctgagctggatgagatgtttgacttcaatggggagctgaaaggttctaacaaggaatggatggttgtgtacaccgacaatgaaggtgatatgatgctggttggggatgatccctggaatgagttctgcaacatggtccacaagatcttcatctacacaagggaggaggtccagaggatgaatccgggcaccctgaattcaaggtccgaggacagccttgctaattcaatggaaaggggctctactgctagggagacacctggcagcctatccgcctcttcccttgactctgagaactgctaa

SEQ ID NO: 239 - protein, 854 aa, Sorghum bicolor
  misc_feature: Ceres Annot ID no. 8690553
  misc_feature (1)..(854): Bit score of 1661.5 for hmm based on sequences of FIGURE 5.
  misc_feature (277)..(359): Pfam Name: Auxin_resp Pfam Desc: Auxin response factor
  misc_feature (150)..(255): Pfam Name: B3 Pfam Desc: B3 DNA binding domain
  misc_feature: Is Acted Upon By Ceres SEEDLINE ID no. ME00572 at SEQ ID NO. 111
MTSAAAAAQAAGGGGGGGGVCEGDAAAAARGGGGGGTEDGMYTELWSLCAGPLVTVPRVGDKVYYFPQGHIEQVEASTNQVAEQHMQLYNLPWKILCEVMNVELKAEPDNDEVYAQLTLLPESKPEENGSSQEEMPAAPPAALARPRVHSFCKTLTASDTSTHGGFSVLRRHADECLPPLDMSRQPPTQELVAKDLHGVEWRFRHIFRGQPGRLFLQSGWSVFVSAKRLVAGDAFIFLRGDNGELRVGVRRAMRQQANVPSSVISSHSMHLGVLATAWHAVNTGTMFTVYYKPRTSPAEFVVPCDRYTESLKRNYPIGMRFKMRFEGEEAPEQRFTGTIVGNVDPEQAGWAESKWRYLKVRWDEASSIPRPERVSPWQIEPAVSPPPVNPLPVHRPKRPRSNAVASLAESSAPTKEAAPKVTLETQQHALQRPLQTQDNAAPKSGFGDNSELDAAHKSALRPSGFDLEKNTIGMQRKLGSDSWMHMNRPEGYNEMLSGYQQPNKDVQNPQGFCSLPDQIAAGRPNFWHTVNAHYQDQQGNHNLFPGSWSMMPSSTGFGLNRQSYPMMQEVGGLSQSATNTKFGNGAYAALPGHGIDQYSSGWFGHMIPGARMDDVQPRVIKPQPLVLAHGEAQKMKGNSCKLFGIHLDSPAKSEPLKSPPSVAYDGMPQTPAAAEWRMVDSIEADRCSDPLKMPKQLDATQVDPVPEKCSQVSRGTQCKSQGGSTRSCKKVHKQGIALGRSVDLTKFNGYTELIAELDEMFDFNGELKGSNKEWMVVYTDNEGDMMLVGDDPWNEFCNMVHKIFIYTREEVQRMNPGTLNSRSEDSLANSMERGSTARETPGSLSASSLDSENC

SEQ ID NO: 240 - DNA, 2924 bp, Panicum virgatum
  misc_feature: Ceres Clone ID no. 1744705
  misc_feature: Encodes the peptide sequence at SEQ ID NO. 241
agccagccaacctacccgccccggacagcaaagcacaggcgcacgagcccccccagctccacgcctcctcctcctccctccccctctcccgccatcctcctccgccgcgcgccttcccgcccgccgagcctttaggagggggtttccggagtcgcggacgcgcgtgcgagaccccttcccctgccgccgagcgcaagtaagatctccggcctcccgccccgcgcgctccgggcgcctcctctctcccctgaattgcccgggctcgggggctctaacggctgccccggtggcgctgcgcgcgcagatctgccgagctcggcatggggtgaccagatcggggcgcggctcggggctctacggctgaattccgctcggtgaggagggagctggtctcggagaggccggggggatggcgaacgccggcgcggccgtcggtccagggggtgctagcgatgctttgttcagggaactctggcatgcttgtgctgggccgttggtcacggtgcctcgccaaggcgagctggtttactacttcccgcaaggtcatatggaacagcttgaagcatctacagatcagcaacttgaccagcacttacctttgtttaatctaccatccaagatcctgtgcaaagtggtaaatgtagaactcagagctgaaactgattccgatgaagtttatgctcaaattatgctgcaaccagaagcagatcaaaatgagcccactggcccagatcctgagccaccagagccagaaaggtgcaatgtccattccttctgcaagactttgactgcttcagacacgagcacccatggtggtttctctgtcctcaggagacatgctgaagaatgtttgccccaattggatatgactcagaatccaccatggcaagaactggtggctaaagatctccatggaaatgaatggcatttccgtcacatctttcgaggtcaaccaaggaggcatctacttacaacaggctggagtgtttttgttagctcaaaaagattggttgctggtgatgcatttatctttttgagaggtgataatggagagctacgagtcggggtaagaaggctcatgaggcaactaaataacatgccatcatcagttatctcaagccatagcatgcatcttggagtcctcgcaacagcatctcatgccatctccactggaactctcttttctgttttctacaaacccagaacaagtcgatcggagtttgttgtgagcgtaaacaagtaccttgaagctaagaatcacaagatgtctgtcggtatgaggtttaaaatgagatttgagggtaatgaatctcctgaaagaagatttagtgggacaattattggtctgggaagcatgccagctaactcaacatctccgtgggctgactctgattggagatctttgaaggtccaatgggatgagccttctgctgttgtccgtccagatagagtttcaccatgggaactagaaccccttaatgcaactaacacacaaccgcctcagcctcctttacggaataagcgtgcacggcctcctgcttcaccttctattgctccagaacttcctccagcttttggtttttggaaatccccagctgagcctacccatcctttctcattttcgggactgcagcgaactcaggaattataccattcaaaccccaattcaatcttttcatcatcgttgaatgtgggatttaattcaaagaatgaacattctactccaaccaacaatcatttgtactggccaattcgagacactagaacggaatcctactctgctagcattaacaaacttctacctgaaaggaagcaagaatccgctactgctggctgcagattgtttggtattgagataagtaatgcagtatcaccagtggttactgttgctagtgttggtcaagaccagccacctgttgagtcagtagatgttgagtctgatcagctgtcacagccatcccaagccaacaaaacagatgctccagcagcaagcagtgagcgctctcctcatgagactgagagccggcaagtcaggagctgcaccaaggtaatcatgcaaggaatggcggttggcagggcagtggacttgacgaggctagaaggatatgatgatcttctccacaagttggaggagatgtttgatatccagggggagctttctgctagcctcaagaaatggaaggttatttacacggatgatgaggatgatatgatgctggtcggggatgatccgtggcctgaattttgcagcatggtgaaaaggatatacatttactcctatgaggaggccaagtctttgactcccaaggcgaagctgccggtcattggtgataccactaaaccgaacccagacaagttgtcaccggaatctgacatgccgcagagtgactcaaacaacagcgctctggttgctgccgataaggactgatggatgctaacttggcgctctacctttaattcccgttttggatgtttgggaggcaatgcccatactccttgagactgctgagagttatctgtttgttgcgctgtgggcccgaaggacgttgccccacaatctgcctgactgccttggtttggaatggctgatgtaggaccagtggtggtcctctgccagcaaggtcgactggaatgtaatggcaagcaggccgcattgcgcgccgttccctgtgccaccaacctgtgttttgtttgccgtgtttggtaggaggcatggcgtatcgctggcctcacctccagagtaaataggactttatgtacaactattttggtagtagcagtagcggtttatgtatatcagcgtcatgttccttgctacctatataagcattatcatctgtagctgctgttcccacctgcattgtattctacccccggcttggtaccggatgctctggtgcaaaaatgtctctgcttgctgttcc

SEQ ID NO: 241 - protein, 672 aa, Panicum virgatum
  misc_feature: Ceres Clone ID no. 1744705
  misc_feature (1)..(672): Bit score of 1346.5 for hmm based on sequences of FIGURE 5.
  misc_feature (248)..(333): Pfam Name: Auxin_resp Pfam Desc: Auxin response factor
  misc_feature (121)..(226): Pfam Name: B3 Pfam Desc: B3 DNA binding domain
  misc_feature: Is Acted Upon By Ceres SEEDLINE ID no. ME00572 at SEQ ID NO. 111
MANAGAAVGPGGASDALFRELWHACAGPLVTVPRQGELVYYFPQGHMEQLEASTDQQLDQHLPLFNLPSKILCKVVNVELRAETDSDEVYAQIMLQPEADQNEPTGPDPEPPEPERCNVHSFCKTLTASDTSTHGGFSVLRRHAEECLPQLDMTQNPPWQELVAKDLHGNEWHFRHIFRGQPRRHLLTTGWSVFVSSKRLVAGDAFIFLRGDNGELRVGVRRLMRQLNNMPSSVISSHSMHLGVLATASHAISTGTLFSVFYKPRTSRSEFVVSVNKYLEAKNHKMSVGMRFKMRFEGNESPERRFSGTIIGLGSMPANSTSPWADSDWRSLKVQWDEPSAVVRPDRVSPWELEPLNATNTQPPQPPLRNKRARPPASPSIAPELPPAFGFWKSPAEPTHPFSFSGLQRTQELYHSNPNSIFSSSLNVGFNSKNEHSTPTNNHLYWPIRDTRTESYSASINKLLPERKQESATAGCRLFGIEISNAVSPVVTVASVGQDQPPVESVDVESDQLSQPSQANKTDAPAASSERSPHETESRQVRSCTKVIMQGMAVGRAVDLTRLEGYDDLLHKLEEMFDIQGELSASLKKWKVIYTDDEDDMMLVGDDPWPEFCSMVKRIYIYSYEEAKSLTPKAKLPVIGDTTKPNPDKLSPESDMPQSDSNNSALVAADKD

SEQ ID NO: 242 - protein, 670 aa, Medicago truncatula
  misc_feature: Public GI ID no. 140053546
  misc_feature (1)..(670): Bit score of 1133.4 for hmm based on sequences of FIGURE 5.
  misc_feature (250)..(332): Pfam Name: Auxin_resp Pfam Desc: Auxin response factor
  misc_feature (119)..(228): Pfam Name: B3 Pfam Desc: B3 DNA binding domain
  misc_feature: Is Acted Upon By Ceres SEEDLINE ID no. ME00572 at SEQ ID NO. 111
MCFSITFTGSTNDALYKELWHACAGPLVTLPREGERVYYFPQGHMEQLEASMNQGLEQQMPSFNLPSKILCKVVNIHLRAEPETDEVYAQITLLPETDQSEVTSPDDPLPEPPRCTVHSFCKTLTASDTSTHGGFSVLRRHADDCLPPLDMTQQPPWQELVATDLHGNEWHFRHIFRGQPRRHLLTTGWSVFVSSKKLVAGDAFIFLRQVVLGENGELRVGVRRLMRQQSNMPSSVISSHSMHLGVLATASHAISTGTLFSVFYKPRTSRSEFIVSINKYLEARNHKLSVGMRFKMRFEGDEVPERRFSGTIVGVEDNKSSVWADSEWRSLKVQWDEPSSILRPDRVSPWELEPLVSTPPANSQPTQRNKRSRPPILPSTMTDSSLQGIWKSPADSPPFPYRDPQHGRDLYPSPRFSSTATSFLGFGGNSPASNKSMYWSSRLENSTEPFSPVALEESGEKRQGTGNGCRLFGIQLLENSNAEESLQTAPLSGRVGDDRSVPSLDVESDQHSEPSNVNRSDIPSVSCDADKSCLRSPQESQSRQIRSCTKVHMQGMAVGRAVDLTRFDGYEDLLRKLEEMFDIEGELCGATKKWLVVYTDNEDDMMMVGDDPWLEFCSVVRKMFIYTPEEVKKLSPKIGLPSNEEGKPSKLDSEAVVNPEDRSSIVGPGC

SEQ ID NO: 243 - DNA, 2031 bp, Sorghum bicolor
  misc_feature: Ceres Annot ID no. 8733583
  misc_feature: Encodes the peptide sequence at SEQ ID NO. 244
atggggattgatctcaacagcgtggaggaggacgagcaggcgccggcgggcgcggtgtgctgcggggagctgtggcacgcgtgcgcgggggctggggtggcgctgccgcggcggggcagcgccgtggtgtacctgcctcaggcgcacctcgcggccggcggcgacggtggggagctgccggcccttgcggcggcgccgcgcgtgccgccgcacgtggtgtgtcgcgtcgtcgacgtcgagctacgcgcggatgcggcgacggacgaggtctatgcgcggcttgcgctggtggcggaggataagatgtttggccgaaacatccatgatggtgaaactgaagagaaggatggtgagaaagaggatggtgatggagaaaagctcacatcgcacatgttctgcaagacactcacagcttctgatacaagcactcatgggggattctctgttcctcggcgggctgcagaggactgctttccaccattggactatgagcagcttaggccttcccaagagcttattgccaaggatttgcatggcatgaaatggaggttccgtcatatctatagaggtcaacctcgtaggcatcttctgacaactggatggagttcatttattaataagaagaaactagtctcaggggatgcagtcttgtttctgagaggtagtgatggcgagctaagattgggtgtgaggagagcagttcaactgaaaaatgaagctctacttgaagctgtcaactgtactgattcgaagctacttatgctgtctgctgtggccagttctttggacaatagaagtatatttcacatctgtttcaacccaaggattggtgcatcagaatttattgtgccatattgcaagtttttgaagggcttgaactatcctttttcaattggaaccagatttaaagttggctgcaagaatgaagatgctaacgagaggtcctttggattgatctcaggtattagtgaagttgatcccatacgctggcctggatcaaaatggaaatctctcttggtaaagtgggatggtgataccaagtacagccaccagaatagagtatctccatgggacatcgagagagttggcagctcagtttcagttactcactgtctttcatcttgtgtttcgaagcgaatgaagttgtgcttcccccaaggcaatttggacgctccaattctagatggaaatggtcgtccagactctgtgggaactgaaggtttccaccaggtcttgcaaggtcaagaattggtgagggttcatggtgctgcatgctctcattcatcagatacccccagatgtcaaggctcttatggaaggagattctctgccgatgtgtggaactgcaagatgaatgatggacacctaaataccactgggtttgcttaccagcccctaggcttcagtgaatctgtcaaattctcagaggtcttgcaaggtcaagaaatgtctcaggtggcagccccttccttcatgagagatgctttcagtgctggcacacagaatggcagggttcgatcatttgattatgtgcagagatcagctgcaactcaaggatatgctctccagcaatttaatctgccagcaacagaagtgcattcaccgtcttctgttcttatgtttaaccaaaccatggtaccacagcctgagttagatggtctgaccaaccgtgaagaagcatatggcagcgggtactcatccattgcaatacagagagaagctgaaccatggccatccacgcagcagcaaagagtgcgcgaaaatggaagcgagcctctcgacacaactgaagcctcagctcctgcaaggatcgcaaaatctggatcggtggacaggggcgtcgggggaagcagctgtaagctttttggtttctccttgactgagaagatccttggaacagagggagttggtgggaaagaagggaactacgaagcggatcggcagactccccgggttctagacttgcttgggcacggccattctacgcccggtgctctgcatgctctttgcgctgctcccttgggaatatga

SEQ ID NO: 244 - protein, 676 aa, Sorghum bicolor
  misc_feature: Ceres Annot ID no. 8733583
  misc_feature (1)..(676): Bit score of 1288.5 for hmm based on sequences of FIGURE 5.
  misc_feature (258)..(339): Pfam Name: Auxin_resp Pfam Desc: Auxin response factor
  misc_feature (131)..(236): Pfam Name: B3 Pfam Desc: B3 DNA binding domain
  misc_feature: Is Acted Upon By Ceres SEEDLINE ID no. ME00572 at SEQ ID NO. 111
MGIDLNSVEEDEQAPAGAVCCGELWHACAGAGVALPRRGSAVVYLPQAHLAAGGDGGELPALAAAPRVPPHVVCRVVDVELRADAATDEVYARLALVAEDKMFGRNIHDGETEEKDGEKEDGDGEKLTSHMFCKTLTASDTSTHGGFSVPRRAAEDCFPPLDYEQLRPSQELIAKDLHGMKWRFRHIYRGQPRRHLLTTGWSSFINKKKLVSGDAVLFLRGSDGELRLGVRRAVQLKNEALLEAVNCTDSKLLMLSAVASSLDNRSIFHICFNPRIGASEFIVPYCKFLKGLNYPFSIGTRFKVGCKNEDANERSFGLISGISEVDPIRWPGSKWKSLLVKWDGDTKYSHQNRVSPWDIERVGSSVSVTHCLSSCVSKRMKLCFPQGNLDAPILDGNGRPDSVGTEGFHQVLQGQELVRVHGAACSHSSDTPRCQGSYGRRFSADVWNCKMNDGHLNTTGFAYQPLGFSESVKFSEVLQGQEMSQVAAPSFMRDAFSAGTQNGRVRSFDYVQRSAATQGYALQQFNLPATEVHSPSSVLMFNQTMVPQPELDGLTNREEAYGSGYSSIAIQREAEPWPSTQQQRVRENGSEPLDTTEASAPARIAKSGSVDRGVGGSSCKLFGFSLTEKILGTEGVGGKEGNYEADRQTPRVLDLLGHGHSTPGALHALCAAPLGI

SEQ ID NO: 245 - DNA, 1974 bp, Sorghum bicolor
  misc_feature: Ceres Annot ID no. 8700968
  misc_feature: Encodes the peptide sequence at SEQ ID NO. 246
atggacgcgcccaaccctgcagcggctgctggctcaggaggaatgcctagtgacgccctgtaccgagagctgtggcatgcgtgtgccggcccgttggtcacagtacctagacaaggcgagcgcgtctattacttcccccagggccatatggagcagcttgaggcgtctacacaccagcagcttgatcagtacttaccgatgttcaatctaccacccaagatcctatgcagtgtagtcaacgtggaactacgggccgaagctgattcagatgaagtttatgctcaaattatgttgcaaccagaagctgatcaaaacgaactcaccagcctggaccctgaaccacaagaacctgaaaaatgcactgcccattccttctgcaagacactgacagcttcagatacgagcactcacggcggtttttctgttcttcggaggcatgctgaagaatgtcttcctcagctggacatgtctctaaatccaccttgccaagaactggttgccaaagatctccatggcactgaatggcattttcgacacatttttcgagggcaacccaagaggcatctccttacaactggctggagtgtctttgttagctcaaagagattggttgcgggggatgcatttatcttcatgagaggtgaaaatggtgagctacgggttggtgtaaggaggctcatgagacaagtaaatagcatgccgtcatctgtcatatcaagccacagcatgcatcttggagtcttggccacagcctcccatgccatctccactggaaccctcttttccgttttctacaaaccaagaactagccgatctgattttattgtgagtgttaacaagtaccttgaagctaagaagcagaaaatatctgttggaatgaggtttaagatgagatttgaaggtgatgaggctcctgaaagaaggttcagtggaacaattattggcattggcagtttgccggcaatgtcaaaatctctgtgggcagattctgactggagatctctaaaggttcaatgggacgaaccttcatccattcttcgtccagatagaatctcaccatgggaagtggagcccctggatgctgctaatccacaatcccctcaacctccaccaaggcctaagcgtccacgacccccagcttcaccttgtatggtttcagaactgccttcaggttttggactctggaaatccccaacagaatcatcccgtacactctcattttcggaacctcaacgggctcgagagttatttccttcaattcccacatcaaccttctcatcttcatcaaacgtcagtttcaattcaaagaatgagccatccatgctaaccacacagttctactggtcagcaagggatacaagagctgactcctgcgctgctagcaccaacacagtcatagttgaaaagaagcaagagccaagttctggtggttgcagattgtttggaattgatatatgctcagctgaggaagaagtattacctgtggttactgctccaggtgttggttatgagcagactgctgcctctgtagagttgaactcggataagctctcacagggatctgatgtcaacaattctgatgccccagcagctagcagtgagcgttcacctcttgaatcccaaagccggcaagtgaggagctgcaccaaggtaattatgcaaggaatggcagttggaagggctgtagacctgacaaagcttagtggctacagtgatctttgccagaagttggaggagatgtttgacatccacggggagctaggttgcacactcaagaaatggcgggtcattttcactgatgatgaggatgacatgatgcttgttggggatgatccttgggatgagttttgcagaatggtgaaaaggatttacatttacacatatgaggaggcgaagaaactgacatccaagtcaaagttacctgttagcagtgacagcagcaagctgagtgctgtaaactcactgtctgaatga

SEQ ID NO: 246 - protein, 657 aa, Sorghum bicolor
  misc_feature: Ceres Annot ID no. 8700968
  misc_feature (1)..(657): Bit score of 1132.7 for hmm based on sequences of FIGURE 5.
  misc_feature (251)..(336): Pfam Name: Auxin_resp Pfam Desc: Auxin response factor
  misc_feature (124)..(229): Pfam Name: B3 Pfam Desc: B3 DNA binding domain
  misc_feature: Is Acted Upon By Ceres SEEDLINE ID no. ME00572 at SEQ ID NO. 111
MDAPNPAAAAGSGGMPSDALYRELWHACAGPLVTVPRQGERVYYFPQGHMEQLEASTHQQLDQYLPMFNLPPKILCSVVNVELRAEADSDEVYAQIMLQPEADQNELTSLDPEPQEPEKCTAHSFCKTLTASDTSTHGGFSVLRRHAEECLPQLDMSLNPPCQELVAKDLHGTEWHFRHIFRGQPKRHLLTTGWSVFVSSKRLVAGDAFIFMRGENGELRVGVRRLMRQVNSMPSSVISSHSMHLGVLATASHAISTGTLFSVFYKPRTSRSDFIVSVNKYLEAKKQKISVGMRFKMRFEGDEAPERRFSGTIIGIGSLPAMSKSLWADSDWRSLKVQWDEPSSILRPDRISPWEVEPLDAANPQSPQPPPRPKRPRPPASPCMVSELPSGFGLWKSPTESSRTLSFSEPQRARELFPSIPTSTFSSSSNVSFNSKNEPSMLTTQFYWSARDTRADSCAASTNTVIVEKKQEPSSGGCRLFGIDICSAEEEVLPVVTAPGVGYEQTAASVELNSDKLSQGSDVNNSDAPAASSERSPLESQSRQVRSCTKVIMQGMAVGRAVDLTKLSGYSDLCQKLEEMFDIHGELGCTLKKWRVIFTDDEDDMMLVGDDPWDEFCRMVKRIYIYTYEEAKKLTSKSKLPVSSDSSKLSAVNSLSE

SEQ ID NO: 247 - protein, 831 aa, Vitis vinifera
  misc_feature: Public GI ID no. 147770011
  misc_feature (1)..(831): Bit score of 909.6 for hmm based on sequences of FIGURE 5.
  misc_feature (280)..(362): Pfam Name: Auxin_resp Pfam Desc: Auxin response factor
  misc_feature (153)..(258): Pfam Name: B3 Pfam Desc: B3 DNA binding domain
  misc_feature: Is Acted Upon By Ceres SEEDLINE ID no. ME00572 at SEQ ID NO. 111
  misc_feature (606)..(606): Xaa is any aa, unknown, or other
MVAMIDLNTVDDDETPSSGSSSSSSSSASASASTVCGSLLSAASSVCLELWHACAGPLISLPKKGSLVVYFPQGHLEQLSDYPAVAYDLPPHVFCRVVDVKLHAEVVTDEVYAQVSLVPETKIKQKLQEGEIEADGGEEEDIEGSIKSMTPHMFCKTLTASDTSTHGGFSVPRRAAEDCFPPLDYKQQRPSQELVAKDLHGFEWRFRHIYRGQPRRHLLTTGWSAFVNKKKLVSGDAVLFLRGGDGELRLGIRRAAQIKGSSPFPALCSQQLNLNTLTAVVNAISTRSVFNICYNPRASSSEFIIPLRKFSKSIDHSFSAGMRFKMRVETEDAAERRYTGLITGISDMDPVRWPGSKWRCLLLHHSHGSECVLLPCLPYYSDSATFFDLSLQVRWDDIEANRHNRVSPWEIELSGSLSGSGSLTVPGSKRTRIGLPGTRPDFSVPNGMGVSDFGESSRFQKVLQGQEIFGFNTPYDGVDTQDHHPSEIRCFPGSSCSRIAAIGNGVRNPLGNSDISYKGIGFGESFRFHKVLQGQETFPSPPCGRALSANQAHENGSFGIFDGVQVPTSRNGWPALVQGYNAHTHLSTPSVQVSSPSSVLMRRSKXLSNRSSFDIPEVYGEKLTPSRCELSVRGGGQGGMNFFGLLNEHNQLAVPHPLVTQSAFRGSQDLVPTCKSSCRLFGFSLTEERSIGNKVDNPTPVTSSLIPGTSFLPQQLHSEPPVMTKAIGSNCTKRTAVVRSKLQFHKLGSVVDQAINRWKLDRHDDLICALKHLFDMEGGLLHGEGNDMHLSLTPAFYSPKSGLAEIQNGYPFANSYVRPVFPENRILDIII

SEQ ID NO: 248 - DNA, 2049 bp, Sorghum bicolor
  misc_feature: Ceres Annot ID no. 8668727
  misc_feature: Encodes the peptide sequence at SEQ ID NO. 249
atgggaatcgatctcaacatggtgggcggcgagggccacgatcgccgcccgccgccgccggtgagccgggagctgtggcacgcgtgcgcggggcccgtggtcgcgctaccgcggcgggggagcctggtcgtgtacctgccgcagggccacctagccgcggcgggcggcggggacgtcgctgcggacctgccgccgcacgtggtgtgccgcgtcgcggatgtcgagctatgcgcggatgcggcgacggacgaggtgtacgcgcggctggcgctggttgcggaaggcgaggcatttgggagaaatctgcacggcggcggagctgaaggggacgatgacatggaggatttggatgctgaaaggaagtcccggatgttgcacatgttctgcaaaacgcttacagcctctgacacaagcacgcatggagggttctctgttcctcgccgtgctgctgaggactgtttcccgcctctggattataatcagctcaggccttctcaagagctggttgccaaggatttgcatggaactaaatggaagtttcgtcatatatataggggtcagcctcgtaggcatctcttgactactggatggagttcatttgtcaataaaaagaaactggtttcaggggatgctgtgttatttctccgaggtgatgatggtgaactaaggcttggtgtacggagagccattcagcttaaaaatgaggccctttttgaagatttcagtagtgacagtacaaagcggcatacattgtcggctgtagctgattccttgaagcacagaagtgtttttcacatttcttacaatccaagagctactgcttcagaatatattattccataccataagttcctgaagagcctcaatcatccagtctgtgttggagcaaggatcaactttcagtgccataatgaagatgttagtgaaaggcgatctggaatggttgttcgcattagtgaaatagatcccatgaaatggcctggctcgaagtggagaagcctgctggtaagatgggaggatggtgctgaatgtaacggccaagatagagtatctccatgggagatcgaggtagctggtggttctgtctctgttgctcattctctgtccgcatctagttctaaaagaaccaagttgtgtgctcagggaaatttggacgttccaacaatgtggaatggttgtactgactccgtggaaactggaaagttacccagggtcttgcaaggtcaagaattgatgggttttaggactcgtcatgttccgtgtgctcctcaaactgctgaggctgcaaaacttcaatcttctgatgctagtaggtttcttagtaatgcacgtgactgcgcattgagtgctccaacaagcagactcgcagtgcataactctggttttacctaccaatctgtaggcttcaatgaatctattggattctcagaggtcttgcaaggtcaagaaatttctcgggcagttcctatgttccaaggaatgatgtctgaggcttgttcactgaaaggcggatatgggctacatagttatatgcataccccagttgctgttaatggattatcagccccagctcaagaatgttgtctgacactatctactccgccaggagcacaagtgccctctctctaccctgataatatttttaaccgaactgtggttccgcagcttggactggcaagcaagtttggtggtggaggtacaaatggccagcagtctggcccatttgataggcggagggaaatttggaccaagccacagcatgaaacacctgatcaaatgaacttggatcagtttgagactagaagagcttcagcacctggagatgctggtaagcttgggtctggtggaggggaggttcgcaaaactagctgcagactttttggtttctccttgactgagaagatcttgccagcagatgatgatggcgtcaaggaagtgagctatgagcctgagtgccagaacccacggatgctggatctgtttgggtacaactgctcaaccccgagtgctgctcttccggctctgtgtgctgcccccattggaatgtga

SEQ ID NO: 249 - protein, 682 aa, Sorghum bicolor
  misc_feature: Ceres Annot ID no. 8668727
  misc_feature (1)..(682): Bit score of 1041.4 for hmm based on sequences of FIGURE 5.
  misc_feature (127)..(232): Pfam Name: B3 Pfam Desc: B3 DNA binding domain
  misc_feature (254)..(335): Pfam Name: Auxin_resp Pfam Desc: Auxin response factor
  misc_feature: Is Acted Upon By Ceres SEEDLINE ID no. ME00572 at SEQ ID NO. 111
MGIDLNMVGGEGHDRRPPPPVSRELWHACAGPVVALPRRGSLVVYLPQGHLAAAGGGDVAADLPPHVVCRVADVELCADAATDEVYARLALVAEGEAFGRNLHGGGAEGDDDMEDLDAERKSRMLHMFCKTLTASDTSTHGGFSVPRRAAEDCFPPLDYNQLRPSQELVAKDLHGTKWKFRHIYRGQPRRHLLTTGWSSFVNKKKLVSGDAVLFLRGDDGELRLGVRRAIQLKNEALFEDFSSDSTKRHTLSAVADSLKHRSVFHISYNPRATASEYIIPYHKFLKSLNHPVCVGARINFQCHNEDVSERRSGMVVRISEIDPMKWPGSKWRSLLVRWEDGAECNGQDRVSPWEIEVAGGSVSVAHSLSASSSKRTKLCAQGNLDVPTMWNGCTDSVETGKLPRVLQGQELMGFRTRHVPCAPQTAEAAKLQSSDASRFLSNARDCALSAPTSRLAVHNSGFTYQSVGFNESIGFSEVLQGQEISRAVPMFQGMMSEACSLKGGYGLHSYMHTPVAVNGLSAPAQECCLTLSTPPGAQVPSLYPDNIFNRTVVPQLGLASKFGGGGTNGQQSGPFDRRREIWTKPQHETPDQMNLDQFETRRASAPGDAGKLGSGGGEVRKTSCRLFGFSLTEKILPADDDGVKEVSYEPECQNPRMLDLFGYNCSTPSAALPALCAAPIGM

SEQ ID NO: 250 - protein, 670 aa, Vitis vinifera
  misc_feature: Public GI ID no. 157354310
  misc_feature (1)..(670): Bit score of 1095.7 for hmm based on sequences of FIGURE 5.
  misc_feature (246)..(329): Pfam Name: Auxin_resp Pfam Desc: Auxin response factor
  misc_feature (119)..(224): Pfam Name: B3 Pfam Desc: B3 DNA binding domain
  misc_feature: Is Acted Upon By Ceres SEEDLINE ID no. ME00572 at SEQ ID NO. 111
MTCCCLLGAPCDALYKELWHACAGPLVTVPREGERVYYFPQGHMEQLEASTTHQGLDQQMPSFNLPSKILCKVVHVQLRAEPETDEVYAQVTLLPEPDQSEITSPDPPLPEPQRCTVHSFCKTLTASDTSTHGGFSVLRRHADDCLPPLDMSQQPPWQELVAADLHGNEWHFRHIFRGQPRRHLLTTGWSVFVSSKKLVAGDAFIFLRGENGELRVGVRRLMRQLSNMPSSVISSHSMHLGVLATASHAISTGTLFSVFYKPRTSRSEFIVSLNKYLEARNHKLSVGMRFKMRFEGEEVPERRFSGTIVGVGDKNTSSGWADSEWRSLKVQWDEPASIFRPERVSAWELEPLVAAAAPTNLQPAQRNKRARPPVLPSATPDLSVLGMWKSSVESPSGFPYCDPHRGRDLYPSPKFSSITKTNSFSFSGNSSPAAVSSNSMYWSNRMETATESFAPAVNKESGEKRRDTGSGCRLFGFQLLDNSTLEETLPVLTVGEDQPVPSLDVESDQHSEPSNINRSDIPSVSCEPDKLSLRSPQESQSRQIRSCTKVHMQGIAVGRAVDLTRFDRYEDLLKKLEEMFDIQGELCGLTSIWQVVYTDDEDDMMMVGDDPWLEFCSMVRKIFIYTAEEVKRLSPKIKLPAMEEIKPGKLDSDVAVAGTDDQSSVVGPGC

SEQ ID NO: 251 - DNA, 2721 bp, Panicum virgatum
  misc_feature: Ceres Clone ID no. 1769972
  misc_feature: Encodes the peptide sequence at SEQ ID NO. 252
attaatggggtgctcatcctcctgacctcctcgtcctccccctcctctcctcctccccgccgggtcgcggtcggctccgccttttaaccgccttgccctggagggggccgagcggcggaccgcacgggcgcacgaccgcggggggaccggagcaggacccggaaccctagtggcggccgcgcgcgccatgggcatcgatctcaacatggtggacggcgagggcgaggagcggcgccccccgccggcggtgtgccgggacctgtggcacgcgtgcgcggggcccgtagtcgcgctgccgcggcggggcagcctcgtcgtgtacctgccgcagggccacctcgctgcggctggcggcggggacgtcgcggcggacctgccgccgcacgtggtgtgccgcgtcgcggacatcgagctatgcgcggatgcggcgacggacgaggtgtacgcacggctggcgctggtggcggagggtgaggcatttgggagaaatgtgcgtgttggtggagttgaaggggacgaggacatggaggattttgatgctgaaaggaagtcccggatgctgcacatgttctgcaaaacgctcactgcctctgacacaagcacgcatggagggttctctgttcctcgtcgagctgctgaggactgtttcccaccgctggactataatcaactcaggccttctcaagagcttgttgccaaggatttgcatggagccaagtggaagtttcgtcatatttataggggtcagcctcgtaggcatctcttaacaactggatggagttcatttgtcaataaaaagaaactggtttcaggggatgcagtcttatttctccgaggtgatgatggtgaactaagactgggtgtaaggagagctgttcagcttaaaaatgaggccctttttgaagaattcagtagcgacagtgcaaagcgacatacgttgtctgctgtatataattccttgaaacataaaagtgtctttcacatttcttacaatccaagagttgctgcttcagaatatataattccttaccggaagttccttaagagcctcaaccatccagtctgtattggagcgaggatcaacttccaatgccagaatgaagatgttagtgaaaggcgatctggaatggttgttggcaatagtgaagtagatcccatgaaatggcctggctcaaagtggagaagcctgctggtaagatgggaggatggttctgaatgcaatggccaagatagagtatctccatgggagatcgatatagttggtggctcagtctctgctgcccattctctgtccgcatctagttctaaaagaaccaagttatgccctccgggaaatttggacgttccaacaatgtggaatggttgtactgactccgtggaaactggaaagttacccagggtcttgcaaggtcaagaattgatgggttttaggactcatcgtgttacgtgtgctcctcaaacagctgaggttgcaaaatttcaatcttctgatgctagtaggttccttactaatgcacgaagctgcatgttgagtggtccaacaggcagacttgcagtacagaactctggctttacctaccaatctctgggcttcagtgaatctattggattctcagaggtcttgcaaggtcaagaaatttctcaggcagttcctatgttccaaggaatgatatctgcggcatgttcactgaagggcggatatgggctgcgtggttatgtgcataccccagctgctgttaatggattatcagccacagctcaagaatgttctctcacactatgtactccacctgcagcacaagtgccccctcctcatcccaatcatatgtttaaccaaactgtgtcgtcccagcttggattgggaaacaagtctgctggcgaagttgcaaatggcagtcagcctcgcccatttgatatgtcgtgggaagctcagaccaggccacagcatgaaatacctgctcaaattagcttggatcaatttgaggctaggagagcttcagcacctggagatgctgctaaaattgggtctggtggaagggaggtgcgcaaaactagctgcaggctttttggtttctcattgactgagaagatcttgccagctgatgatgatggcgtgaaggaagtgagttatgaggctgagtgccagaatccacggatgctggacttgttcgggtacaactgctccaccccaagtgctgctcttccagctctctgtgccgcccccttcggaatgtgatgctactttagtaatctttccaagtattttcaagcactcagattagacgtactttcccagtaccccagtgtgtgcataagctgtcttttgacctcattccctccattggcctgctcatgttaatcagtcatctgcacgagtcaaggaaggatgattggtgaaccattcctctgcatggctcacctggccacccaaagtattatggttgtgtatcgtgatatgcaccattgtaacttttgtggctatccttcagacccattgtgcgatgaagctaacgatgtgccctaaaagtacttcgctcacagatttggattcatgggaaggtctgtcagctttgatgtaccggttatgtgtctttaactgagctcctgtatgacttttgtagctcagtcatgagccgtgtttgcactggtgcctaggtcgtgtgattgtatcagtatgtaagactattgcttcgtttcaagatatgttgcttatggaccttt

SEQ ID NO: 252 - protein, 682 aa, Panicum virgatum
  misc_feature: Ceres Clone ID no. 1769972
  misc_feature (1)..(682): Bit score of 1072.6 for hmm based on sequences of FIGURE 5.
  misc_feature (127)..(232): Pfam Name: B3 Pfam Desc: B3 DNA binding domain
  misc_feature (254)..(335): Pfam Name: Auxin_resp Pfam Desc: Auxin response factor
  misc_feature: Is Acted Upon By Ceres SEEDLINE ID no. ME00572 at SEQ ID NO. 111
MGIDLNMVDGEGEERRPPPAVCRDLWHACAGPVVALPRRGSLVVYLPQGHLAAAGGGDVAADLPPHVVCRVADIELCADAATDEVYARLALVAEGEAFGRNVRVGGVEGDEDMEDFDAERKSRMLHMFCKTLTASDTSTHGGFSVPRRAAEDCFPPLDYNQLRPSQELVAKDLHGAKWKFRHIYRGQPRRHLLTTGWSSFVNKKKLVSGDAVLFLRGDDGELRLGVRRAVQLKNEALFEEFSSDSAKRHTLSAVYNSLKHKSVFHISYNPRVAASEYIIPYRKFLKSLNHPVCIGARINFQCQNEDVSERRSGMVVGNSEVDPMKWPGSKWRSLLVRWEDGSECNGQDRVSPWEIDIVGGSVSAAHSLSASSSKRTKLCPPGNLDVPTMWNGCTDSVETGKLPRVLQGQELMGFRTHRVTCAPQTAEVAKFQSSDASRFLTNARSCMLSGPTGRLAVQNSGFTYQSLGFSESIGFSEVLQGQEISQAVPMFQGMISAACSLKGGYGLRGYVHTPAAVNGLSATAQECSLTLCTPPAAQVPPPHPNHMFNQTVSSQLGLGNKSAGEVANGSQPRPFDMSWEAQTRPQHEIPAQISLDQFEARRASAPGDAAKIGSGGREVRKTSCRLFGFSLTEKILPADDDGVKEVSYEAECQNPRMLDLFGYNCSTPSAALPALCAAPFGM

SEQ ID NO: 253 - DNA, 2421 bp, Solanum lycopersicum
  misc_feature: Ceres Annot ID no. 8460878
  misc_feature: Encodes the peptide sequence at SEQ ID NO. 254
atggctacttctgagaattgccggaacgctgccggcgccggaaaagttgatgctgagaaagcgttgtacacggagctatggcgagcatgtgcaggtccgcttgtgacagtgccatgtgaaggcgagctggtgttctatttcccacaaggtcatattgaacaggttgaagcatcaacaaaccaagcttcagaccagcagatgccagtatataatcttccttctaagatcctctgtcgtgtgattaacgtcctgctgaaggctgaacccgatacagatgaggtgtatgcacaagtgactttgttgccagaaccaaatcaagatgagaatgtggtatcaaaggaaccgatgccctctccgccaccacgattccatgtgcactctttttgtaagacattaacagcctctgataccagcactcatggaggattttctgtcttgagacggcatgctgatgaatgcctcccgcctctggttagaaagaattctttctcaatacagttatggtgcctgtattttgataatcctccaacacaggagttggtggccaaagatttgcatgcaaatgagtggcgcttcaggcacatattccggggccagcctaggaggcaccttcttcagagtggttggagtgtctttgttagttcgaaaaggcttgttgcaggggatgcattcatatttcttagaggtgagaatggggagcttcgtgttggagtccgacgtgccatgagacagcagggtaatgctccatcatcagtgatatccagtcatagcatgcatcttggtgtccttgctacagcttggcatgctattcagacgaaaacactgacgagccctgctgactttatagttccatatgatcagtatatggagtctctgaaaaacaattactccatcgggatgaggtttaaaatgaggtttgaaggtgaagaagctccagaacagaggtttactggaactatagttggcattgaaaatgctgacctcaaaaggtggcctgagtcaaaatggagatgcctgaaggttcgatgggatgaaacttctgctattcctaggccagaccgagtttcaccctggaaagtagagccagctcttagccctcctgcacttaatccacttccaataccaaggcagaaaaggccgcgatcaaatgttctgccctcgtctcctgattcttctgtacttactagggaaggttcatccaaagtagttgtagacacttcacaagccagtgggttttcaagagttttgcaaggtcaagaaatatcaaccttgagaggcaattttgtagaaaataacgagtcggactcttctgagaagccacctatatggcaaccattactggatgacgagaaggctgatgttcattctgcgtcaaggaaatgtatatcagataaacggcttcctttagggaggcctgaatcatcttttacagatcttttatcaggttttggggggcaatctagttcatctcatggattccattcacccactgggggccaaacagcacctgctagctgggttaagcgacaagctctggataaggaaactgatttcagcttactggcaaaacaatggtctctagtgtcttctggtctctcacttaatctgatggaatcaggattgaagggtgcagatactctgtatcaaatgcggggaacatctcgactcaattgttttaacgagtatccaaccttccctggtcatagacctgacaatcagcagggaaattggttaatgcccccgtccgtgctgccttatattcagatgtccgctcattctggagaaattatgcctaaacccatggcttcaccacagcccgaagccatgaaacccaaagaagggaactgcaaactatttggcattccccttgtaagtaaatgtgccaccatagatcctgtcatgttgcggaaaaattccccgattcactcaacaagtaacatgcactttggtatacatccacatcaattccctataattgaatctgatcaaaggtctgagcaatcaaagggatcaaagctaccagatgatggcttcatagttcatgatcaggaagaacaattccaaacctctcatcctggtactcgagatagagagggcaaaggccttgttcattcaacaaggagttgcaccaaggttcataaacagggtacagcccttggaaggtctgttgatcttgcaaagttcaacaactatgaagaattgatagctgaactggatcacatttttgattttaatggtgagctcaaggctcgtaacaagaactggctgatttttatctacacgaaagatgaggtgcagcggatgaaccctgggactctcaattcaaaaggcgaggacaattcttctgttgcagaaggctctgatgctaaagaagtgaagaatctacagcttcacattgattccagtccggaagattcttag

SEQ ID NO: 254 - protein, 806 aa, Solanum lycopersicum
  misc_feature: Ceres Annot ID no. 8460878
  misc_feature (1)..(806): Bit score of 1407.8 for hmm based on sequences of FIGURE 5.
  misc_feature (266)..(340): Pfam Name: Auxin_resp Pfam Desc: Auxin response factor
  misc_feature (127)..(244): Pfam Name: B3 Pfam Desc: B3 DNA binding domain
  misc_feature: Is Acted Upon By Ceres SEEDLINE ID no. ME00572 at SEQ ID NO. 111
MATSENCRNAAGAGKVDAEKALYTELWRACAGPLVTVPCEGELVFYFPQGHIEQVEASTNQASDQQMPVYNLPSKILCRVINVLLKAEPDTDEVYAQVTLLPEPNQDENVVSKEPMPSPPPRFHVHSFCKTLTASDTSTHGGFSVLRRHADECLPPLVRKNSFSIQLWCLYFDNPPTQELVAKDLHANEWRFRHIFRGQPRRHLLQSGWSVFVSSKRLVAGDAFIFLRGENGELRVGVRRAMRQQGNAPSSVISSHSMHLGVLATAWHAIQTKTLTSPADFIVPYDQYMESLKNNYSIGMRFKMRFEGEEAPEQRFTGTIVGIENADLKRWPESKWRCLKVRWDETSAIPRPDRVSPWKVEPALSPPALNPLPIPRQKRPRSNVLPSSPDSSVLTREGSSKVVVDTSQASGFSRVLQGQEISTLRGNFVENNESDSSEKPPIWQPLLDDEKADVHSASRKCISDKRLPLGRPESSFTDLLSGFGGQSSSSHGFHSPTGGQTAPASWVKRQALDKETDFSLLAKQWSLVSSGLSLNLMESGLKGADTLYQMRGTSRLNCFNEYPTFPGHRPDNQQGNWLMPPSVLPYIQMSAHSGEIMPKPMASPQPEAMKPKEGNCKLFGIPLVSKCATIDPVMLRKNSPIHSTSNMHFGIHPHQFPIIESDQRSEQSKGSKLPDDGFIVHDQEEQFQTSHPGTRDREGKGLVHSTRSCTKVHKQGTALGRSVDLAKFNNYEELIAELDHIFDFNGELKARNKNWLIFIYTKDEVQRMNPGTLNSKGEDNSSVAEGSDAKEVKNLQLHIDSSPEDS

SEQ ID NO: 255 - protein, 862 aa, Vitis vinifera
  misc_feature: Public GI ID no. 157343873
  misc_feature (1)..(862): Bit score of 1864.9 for hmm based on sequences of FIGURE 5.
  misc_feature (289)..(371): Pfam Name: Auxin_resp Pfam Desc: Auxin response factor
  misc_feature (162)..(267): Pfam Name: B3 Pfam Desc: B3 DNA binding domain
  misc_feature: Is Acted Upon By Ceres SEEDLINE ID no. ME00572 at SEQ ID NO. 111
MASSEVSIKGNCGHGRGESFTSGYSEPNDGGVSRSVAEGQKGHSSVSGAGKDFETALYTELWHACAGPLVTVPRERERVFYFPQGHIEQVEASTNQVSDQQMPVYDLPSKILCRVINVQLKAEPDTDEVFAQVTLLPEPNQDETAQEKEPLPPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAKSTGTMFTVYYKPRTSPAEFIVPFDQYMESVKNNYSIGMRFKMRFEGEEAPEQRFTGTIVGIEDADPKRWRDSKWRCLKVRWDETSTIPRPDRVSPWKIEPAVTPPALNPLPVPRPKRPRSNMVPSSPDSSVLTREGSSKVTVDPSPASGFSRVLQGQEFSTLRGTFAESNESDTAEKSVVWPPLLDDEKIDVVSTSRRFGSDNWMHLVRHEPTCTDLLSGFGARTDSSHGFSSFVDQNDVAANTMKKHLEHESKFNLLAGPWSMMPSGLSLNLLESSIKVPVQGSDMPYQTRGDARFGGFSEYPTLHGHRVELQQGNWLMPPPAQSHFENFAHSRELMPKPILVQKQEAVKPKDGNCKLFGIPLIGNPVISEPAMSYRSMTNEPAGHLHLAPSAFDSDQKSEQSKGAKSTDNPLAVSEQEKPCQTSLPLSRDVQGKVQSVSTRSCTKVHKQGIALGRSVDLTKFNNYDELIAELDQLFEFGGELMAPKKNWLIVYTDDEGDMMLVGDDPWQEFCGMVRKIYIYTREEVQRMNPGTLNSKNDDNPSVAEGMDAKEVKRQPVPLTSNLENC

SEQ ID NO: 256 - protein, 946 aa, Vitis vinifera
  misc_feature: Public GI ID no. 147791931
  misc_feature (1)..(946): Bit score of 1795.4 for hmm based on sequences of FIGURE 5.
  misc_feature (289)..(371): Pfam Name: Auxin_resp Pfam Desc: Auxin response factor
  misc_feature (162)..(267): Pfam Name: B3 Pfam Desc: B3 DNA binding domain
  misc_feature: Is Acted Upon By Ceres SEEDLINE ID no. ME00572 at SEQ ID NO. 111
MASSEVSIKGNCGHGRGESFTSGYSEPNDGGVSRSVAEGQKGHSSVSGAGKDFETALYTELWHACAGPLVTVPRERERVFYFPQGHIEQVEASTNQVSDQQMPVYDLPSKILCRVINVQLKAEPDTDEVFAQVTLLPEPNQDETAQEKEPLPPPPPRFHVHSFCKTLTASDTSTHGGFSVLRRHADECLPQLDMSRQPPTQELVAKDLHGNEWRFRHIFRGQPRRHLLQSGWSVFVSSKRLVAGDAFIFLRGENGELRVGVRRAMRQQGNVPSSVISSHSMHLGVLATAWHAKSTGTMFTVYYKPRTSPAEFIVPFDQYMESVKNNYSIGMRFKMRFEGEEAPEQRFTGTIVGIEDADPKRWRDSKWRCLKVRWDETSTIPRPDRVSPWKIEPAVTPPALNPLPVPRPKRPRSNMVPSSPDSSVLTREGSSKVTVDPSPASGFSRVLQGQEFSTLRGTFAESNESDTAEKSVVWPPLLDDEKIDVVSTSRRFGSDNWMHLVRHEPTCTDLLSGFGARTDSSHGFSSFVDQNDVAANTMKKHLEHESKFNLLAGPWSMMPSGLSLNLLESSIKVPVQGSDMPYQTRGDARFGGFSEYPTLHGHRVELQQGNWLMPPPAQSHFENFAHSRELMPKPILVQKQEAVKPKDGNCKLFGIPLIGNPVISEPAMSYRSMTNEPAGHLHLAPSAFDSDQKSEQSKGAKSTDNPLAVSEQEKPCQTSLPLSRDVQGKVQSVSTRSCTKVCIHSLDGCWFLNNEYEIWKMLAGYKIVPQICFIAVSCLMSIGNLVHKQGIALGRSVDLTKFNNYDELIAELDQLFEFGGELMAPKKNWLIVYTDDEGDMMLVGDDPWQEFCGMVRKIYIYTREEVQRMNPGTLNSKNDDNPSVAEGMDAKEVKQKLAMVVLVGRAIELIEMHKSLLPLLDRFLNGCTFGWFLFSGLWEAPVDDGF

SEQ ID NO: 257 - DNA, 2124 bp, Sorghum bicolor
  misc_feature: Ceres Annot ID no. 8734042
  misc_feature: Encodes the peptide sequence at SEQ ID NO. 258
atggcggggatcgacctcaacgacaccgtggaggaggacgaggaggaggcggagcccggcaaccccgcctgctcccagcaaagccggaccagctccgcggccacgcccccacccccgccgctgaccccgctgctccagccgaggccgggcgccgcggtgtgcctcgagctctggcacgcctgcgccggccccgtcgcgccgctgccgcggaaagggaccgtcgtcgtctacctcccgcagggacacctggagcacctcggtgacgccgccgcggccgcagccggaggcgcgccggcgcccgccgccctgccgccccacgtcttctgccgcgtcgtcgacgtcactctccatgcggacgcgtccacggacgaggtgtacgcccagctcgccctcgtcgccgagaacgaggatgtcgcgaggcggctgcgcggagggtccgaggacgggagcgctggggacggcgacgacggggaggccgtgaagcagcggttctcgcggatgccgcacatgttctgcaagacgctcacggcctccgacaccagcacgcacggcggcttctccgtgccgcgccgcgccgccgaggactgcttcccgcctctggactacagccagcagcggccgtcgcaggagcttgtcgccaaggatttgcacggaaccgagtggaggttccgccacatttatcgaggccagccccgcaggcaccttttaaccactggatggagtgcatttgtcaacaagaagaagcttgtctcaggggacgctgtactatttttgagaggtgatgatggggagctaagacttggagtgcgccgtgcagctcagcttaaaaatggatctgcttttccagctctttataatcagtgttctaatcttggttcactagctaacgtagcacatgctgtggccacaaaaagcgtgttccacatctactacaaccccagattaagccaatctgaattcattataccgtattcaaagtttatgaagagcttcagtcaacaattttctgctggtttgaggttcaaaatgagatatgagagtgatgatgcttctgaaagaagatgcactggggtaatagcaggaattggtgatgctgaccccatgtggcgtggttcgaagtggaaatgtttgatggtccgatgggatgatgatgtagattttcgtcgaccgaacaggatttctccttgggagattgagctgactagttcagtttcaggatcccatctgtctgcaccaaatgcaaagagactcaaaccatgtcttcccccggactacctagttccaaatggaagtggttgtcctgattttgcggaatctgcccaattccacaaggtcttgcaaggtcaagaattattgggttatagaactcgtgacaatgctgctgttgcaacttctcaaacaccactaggaaaccctaggttttcctaccattgctcaggctttggggagtctccaagattccaaaaggtcttgcaaggtcaagaagtatttcaaccctaccgaggaactctagtcgatccaagtttgagaaatagtggctttcatcagcaagatggttctcatgtgcctactcaagcgaataagtggcatccacagcttcatgggtgtgcttttcgtgggacacaagcaccagctattccatctcaatcctcatcgccaccatctgtcctaatgtttcaacgagataatccaaagatgtccccttttgaatttgggcattgtcacatggataagaatgaggatatgcgtgcaatgtttggccatgctggaggtattggaagaactgagcaaacaatgatgctccaggctcataatgtttctggaggaatgggaaatagagatgtgaccgttgagaaatttcagcccactgttgctgttggaagggatggatcagacaacagggaagttaccaaaaatagttgcaaaatatttggcatatctttgactgagaaggttccagcaatcaaagaaaaggactgtggtgataccaactatccatcccccttcctgtctttgaagcaacacgtgccaaaatcgctgggcaacagttgtgccactattcatgagcagaggcctgttgttggtagggtgattgatgtttcaacagtggatatgatgatctga

SEQ ID NO: 258 - protein, 707 aa, Sorghum bicolor
  misc_feature: Ceres Annot ID no. 8734042
  misc_feature (1)..(707): Bit score of 1084.7 for hmm based on sequences of FIGURE 5.
  misc_feature (297)..(378): Pfam Name: Auxin_resp Pfam Desc: Auxin response factor
  misc_feature (170)..(275): Pfam Name: B3 Pfam Desc: B3 DNA binding domain
  misc_feature: Is Acted Upon By Ceres SEEDLINE ID no. ME00572 at SEQ ID NO. 111
MAGIDLNDTVEEDEEEAEPGNPACSQQSRTSSAATPPPPPLTPLLQPRPGAAVCLELWHACAGPVAPLPRKGTVVVYLPQGHLEHLGDAAAAAAGGAPAPAALPPHVFCRVVDVTLHADASTDEVYAQLALVAENEDVARRLRGGSEDGSAGDGDDGEAVKQRFSRMPHMFCKTLTASDTSTHGGFSVPRRAAEDCFPPLDYSQQRPSQELVAKDLHGTEWRFRHIYRGQPRRHLLTTGWSAFVNKKKLVSGDAVLFLRGDDGELRLGVRRAAQLKNGSAFPALYNQCSNLGSLANVAHAVATKSVFHIYYNPRLSQSEFIIPYSKFMKSFSQQFSAGLRFKMRYESDDASERRCTGVIAGIGDADPMWRGSKWKCLMVRWDDDVDFRRPNRISPWEIELTSSVSGSHLSAPNAKRLKPCLPPDYLVPNGSGCPDFAESAQFHKVLQGQELLGYRTRDNAAVATSQTPLGNPRFSYHCSGFGESPRFQKVLQGQEVFQPYRGTLVDPSLRNSGFHQQDGSHVPTQANKWHPQLHGCAFRGTQAPAIPSQSSSPPSVLMFQRDNPKMSPFEFGHCHMDKNEDMRAMFGHAGGIGRTEQTMMLQAHNVSGGMGNRDVTVEKFQPTVAVGRDGSDNREVTKNSCKIFGISLTEKVPAIKEKDCGDTNYPSPFLSLKQHVPKSLGNSCATIHEQRPVVGRVIDVSTVDMMI

SEQ ID NO: 259 - protein, 687 aa, Oryza sativa subsp. japonica
  misc_feature: Public GI ID no. 158564103
  misc_feature (1)..(687): Bit score of 984.1 for hmm based on sequences of FIGURE 5.
  misc_feature (259)..(340): Pfam Name: Auxin_resp Pfam Desc: Auxin response factor
  misc_feature (132)..(237): Pfam Name: B3 Pfam Desc: B3 DNA binding domain
  misc_feature: Is Acted Upon By Ceres SEEDLINE ID no. ME00572 at SEQ ID NO. 111
MGIDLNTVEEEAEEGAAAAVCGELWHACAGPGVALPRRGSALVYLPQAHLAADGGGGEVPPAGAAAVPPHVACRVVGVELRADAATDEVYARLALVAEGEMLQRNFREGGGEDGAGEMEGCDAEKKPRMPHMFCKTLTASDTSTHGGFSVPRRAAEDCFPPLDYKTVRPSQELIAVDLHGTQWKFRHIYRGQPRRHLLTIGWSSFVNRKKLVSGDAVLFLRGDDGQLRLGVRRAVQLRNEALFEPVNSSDSKLRILSSVASSLENKSVFHICFNPRSGASEFIVPYWRLLKSLNHPFSIGMRFRVCYESEDANERSAGLISGISEVDPIRWPGSRWKCLLVRWDDSTDSSHQNRVSPWEIERVGGSVSVTHSLSSGSKRTKLHFPQGSLDTPFLNGNGHPDSMGTENFHRVLQGQEFRGSRSHGVVCSESPGVPNFQSPDNRRFSADMRGYMMPASGPPQRNTEFTYQPIGFSESLGFPEVLQGQEMSQVVPLFRGATFGARTQNDRVVSANSVHRSAAQSGLLASTLGHPISQFTLSSSKVSSPSSVLMFNQATAPNHETVSGTNNKGMHVSQFASQEMLSETVTWPGTQRQTPSEITSNQFALARIPAPPSGAESGLPKRDAGRSSCRLFGFSLTGNMLGEDGEGLDDGAIEAGCENPPVLELFGHSHSTPGALHALCAAAPLGM

SEQ ID NO: 260 - protein, 653 aa, Vitis vinifera
  misc_feature: Public GI ID no. 157360302
  misc_feature (1)..(653): Bit score of 952.6 for hmm based on sequences of FIGURE 5.
  misc_feature (243)..(322): Pfam Name: Auxin_resp Pfam Desc: Auxin response factor
  misc_feature (116)..(221): Pfam Name: B3 Pfam Desc: B3 DNA binding domain
  misc_feature: Is Acted Upon By Ceres SEEDLINE ID no. ME00572 at SEQ ID NO. 111
MMVGFGGEGDDLYAELWKACAGPLVDVPRRGERVFYFPQGHVEQLEASTNQELSQRIPLFNLPSKILCRVIHIQLRAEQETDEVYAQITLLPEPDQAEPRSPDPCTPEPPRPTVHSFCKVLTASDTSTHGGFSVLRKHANECLPQLDMNQATPTQELVAKDLHGYEWRFKHIFRGQPRRHLLTTGWSTFVTSKRLVAGDSFVFLRGDNGELRVGVRRLARQQSTMPTSVISSQSMHLGVLATASHAVATQTLFIVYYKPRTSQFIIGLNKYLEAVSNGFAVGMRFKMRFEGEDSPERRFSGTIVGGEDFSPEWKDSEWRSLKVQWDEPASIPRPEKVSPWEIEHYVSSVPQGLAPPGVLKNKRPRSNESPVPGSAAASAVWHLGLTQSHDLTQMSSTAEGKRSENHQADIGAIPPTEGSWLSSSHVSASQHQFQDATEDSKSVSAWPALSGYSTLHSSKLTSDTIIDPNGNGKKAVAEMATSCRLFGFELMNHSSSPPVGKAHGHSISSDLSKASKEQKQGQSHVSPKEIQSKQNCYSNTRSRTKVQMQGIAVGRAVDLTALEGYDELIDELEEMFEIKGELRPRYKWEIVFTDDEGDMMLVGDDPWPEFCNMVRRIFICSSQDVKKMSPGSKLPISSMEGEGTTISLDSTEN

What is claimed is:

1. A method of producing a plant and/or plant tissue, said method comprising growing a plant cell comprising an exogenous nucleic acid, said exogenous nucleic acid comprising a regulatory region operably linked to a nucleotide sequence encoding a polypeptide, wherein said polypeptide has 90% or greater sequence identity to the amino acid sequence of SEQ ID NO:2 and wherein a plant produced from said plant cell has an increased level of cold tolerance as compared to the corresponding level of cold tolerance of a control plant that does not comprise said nucleic acid.

2. A method of increasing the level of cold tolerance in a plant, said method comprising introducing into a plant cell an exogenous nucleic acid, said exogenous nucleic acid comprising a regulatory region operably linked to a nucleotide sequence encoding a polypeptide, wherein said polypeptide has 90% or greater sequence identity to the amino acid sequence of SEQ ID NO:2 and wherein a plant produced from said plant cell has an increased level of cold tolerance as compared to the corresponding level of cold tolerance of a control plant that does not comprise said exogenous nucleic acid.

3. A plant cell comprising an exogenous nucleic acid, said exogenous nucleic acid comprising a regulatory region operably linked to a nucleotide sequence encoding a polypeptide, wherein said polypeptide has 90% or greater sequence identity to the amino acid sequence of SEQ ID NO:2, and wherein a plant produced from said plant cell has an increased level of cold tolerance as compared to the corresponding level of cold tolerance of a control plant that does not comprise said nucleic acid.

4. The plant cell of claim 3, wherein the polypeptide has 95 percent or greater sequence identity to the amino acid sequence of SEQ ID NO:2, and wherein the plant produced from said plant cell exhibits increased growth under cold-stress condition as compared to the control plant and wild-type growth under standard condition.

5. The plant cell according to claim 3, wherein the polypeptide has 97 percent or greater sequence identity to the amino acid sequence of SEQ ID NO:2.

6. The plant cell according to claim 3, wherein the nucleotide sequence has 90% or greater sequence identity to SEQ ID NO:1.

7. A transgenic plant comprising the plant cell of claim 3, wherein the plant exhibits increased growth under cold-stress condition as compared to the control plant and the plant further exhibits wild-type growth under standard condition.

8. The transgenic plant of claim 7, wherein said polypeptide comprises SEQ ID NO:2.

9. The transgenic plant of claim 7, wherein said plant is a member of a species selected from the group consisting of *Panicum virgatum, Sorghum bicolor, Miscanthus giganteus, Saccharum* sp., *Populus balsamifera, Zea mays, Glycine max, Brassica napus, Triticum aestivum, Gossypium hirsutum, Oryza sativa, Helianthus annuus, Medicago sativa, Beta vulgaris*, and *Pennisetum glaucum*.

10. A seed product comprising embryonic tissue from the transgenic plant according to claim 7, wherein the seed product comprises the exogenous nucleic acid.

* * * * *